United States Patent
Cani et al.

(10) Patent No.: US 11,690,879 B2
(45) Date of Patent: Jul. 4, 2023

(54) *DYSOSMOBACTER*, A NOVEL BACTERIAL GENUS OF THE GASTROINTESTINAL MICROBIOTA AND USES THEREOF

(71) Applicant: UNIVERSITÉ CATHOLIQUE DE LOUVAIN, Louvain la Neuve (BE)

(72) Inventors: Patrice Cani, Brussels (BE); Tiphaine Le Roy, Le Mans (FR)

(73) Assignee: UNIVERSITÈ CATHOLIQUE DE LOUVAIN, Louvain la Neuve (BE)

( * ) Notice: Subject to any disclaimer, the term of this patent is extended or adjusted under 35 U.S.C. 154(b) by 0 days.

(21) Appl. No.: 17/258,256

(22) PCT Filed: Jul. 10, 2019

(86) PCT No.: PCT/EP2019/068539
§ 371 (c)(1),
(2) Date: Jan. 6, 2021

(87) PCT Pub. No.: WO2020/011856
PCT Pub. Date: Jan. 16, 2020

(65) Prior Publication Data
US 2021/0338745 A1   Nov. 4, 2021

(30) Foreign Application Priority Data

Jul. 10, 2018 (EP) .................................. 18305916

(51) Int. Cl.
*A61K 35/74* (2015.01)
*A61P 3/04* (2006.01)
(Continued)

(52) U.S. Cl.
CPC ................ *A61K 35/74* (2013.01); *A61P 3/04* (2018.01); *A61P 3/06* (2018.01); *C12N 1/205* (2021.05); *A23L 33/135* (2016.08); *A61K 8/99* (2013.01)

(58) Field of Classification Search
None
See application file for complete search history.

(56) References Cited

FOREIGN PATENT DOCUMENTS

| EP | 2 030 623 A1 | 3/2009 |
|---|---|---|
| WO | 2008/076696 A2 | 6/2008 |

(Continued)

OTHER PUBLICATIONS

Traore, et al., "Desc. of '*B. massiliense* ' gen. nov., sp. nov.,'*M. massiliensis*' gen. nov., sp. nov., '*P. massiliense*' gen. nov., sp. nov. and '*O. massiliensis*' sp. nov., isolated from a faecal specimen . . . ", New Microbes and New Infections, vol. 19, pp. 78-82. (Year: 2017).*

(Continued)

*Primary Examiner* — Renee Claytor
*Assistant Examiner* — Grant C Currens
(74) *Attorney, Agent, or Firm* — Maier & Maier, PLLC

(57) ABSTRACT

A bacterium belonging to a novel bacterial genus, *Dysosmobacter*. Also, the therapeutic, nutraceutical and cosmetic use thereof. The uses include methods for treating a disorder, promoting weight loss, decreasing food intake, increasing muscle mass, decreasing fat mass, increasing satiety, and/or decreasing weight gain associated with food intake in a subject, including administering to the subject at least one isolated bacterium belonging to the genus *Dysosmobacter* and/or a variant thereof and/or fragments thereof.

1 Claim, 27 Drawing Sheets

Specification includes a Sequence Listing.

(51) Int. Cl.
   *A61P 3/06*   (2006.01)
   *C12N 1/20*   (2006.01)
   *A23L 33/135* (2016.01)
   *A61K 8/99*   (2017.01)

(56) References Cited

FOREIGN PATENT DOCUMENTS

| WO | 2014/121301 A1 | 8/2014 |
|----|----------------|--------|
| WO | 2017/182796 A1 | 10/2017 |

OTHER PUBLICATIONS

Sokol et al., "*Faecalibacterium prausnitzii* is an anti-inflammatory commensal bacterium identified by gut microbiota analysis of Crohn disease patients", Proc Natl Acad Sci USA, Oct. 28, 2008, pp. 16731-1676, 105(43); 6 pages.

Eeckhaut et al., "*Butyricicoccus pullicaecorum* in inflammatory bowel disease", Gut. Dec. 2013, pp. 1745-1752, 62(12); 8 pages.

Konikoff and Gophna, "Oscillospira: a Central, Enigmatic Component of the Human Gut Microbiota", Trends Microbiol. Jul. 2016, pp. 523-524, 24(7); 2 pages.

Iino et al., "*Oscillibacter valericigenes* gen. nov., sp. nov., a valerate-producing anaerobic bacterium isolated from the alimentary canal of a Japanese corbicula clam", Int J Syst Evol Microbiol, 2007, pp. 1840-1845, 57; 6 pages.

Lee et al., "*Oscillibacter ruminantium* sp. nov., isolated from the rumen of Korean native cattle", Int J Syst Evol Microbiol, 2013, pp. 1942-1946, 63; 5 pages.

Le Roy et al., "*Dysosmobacter welbionis* gen. nov., sp. nov., isolated from human faeces and embeded description of the genus *Oscillibacter*", International Journal of Systematic and Evolutionary Microbiology, 2019, pp. 4851-4858; 8 pages.

Baggio and Drucker, "Clinical endocrinology and metabolism. Glucagon-like peptide-1 and glucagon-like peptide-2", Best Pract Res Clin Endocrinol Metab. Dec. 2004, pp. 531-554, 18(4); 24 pages.

Oppong et al., "Epithelial cells augment barrier function via activation of the Toll-like receptor 2/phosphatidylinositol 3-kinase pathway upon recognition of *Salmonella enterica* serovar Typhimurium curli fibrils in the gut", Infect Immun. Feb. 2013, pp. 478-486, 81(2); 9 pages.

Gophna et al., "Differences between Tissue-Associated Intestinal Microfloras of Patients with Crohn's Disease and Ulcerative Colitis", Journal of Clinical Microbiology, 2006, pp. 4136-4141, 44(11); 8 pages.

"Uncultured bacterium clone CD69 16S ribosomal RNA gene, partial sequence", EBI accession No. EMBL:DQ441320; 2 pages.

Lagier et al., "Microbial culturomics: paradigm shift in the human gut microbiome study", Clinical Microbiology and Infection, 2012, pp. 1185-1193, 18(12); 9 pages.

European Search Report dated Nov. 23, 2018 in corresponding European application No. 18 30 5916; 3 pages.

International Search Report and Written Opinion of the International Searching Authority dated Sep. 19, 2019 in corresponding International application No. PCT/EP2019/068539; 12 pages.

\* cited by examiner

DYSOSMOBACTER, A NOVEL BACTERIAL GENUS OF THE GASTROINTESTINAL MICROBIOTA AND USES THEREOF

FIELD

The present invention relates to the gut microbiota. More specifically the present invention relates to bacteria of the genus *Dysosmobacter* and their use in the treatment of gut microbiota-related disorders.

BACKGROUND

The human gut is colonized by a diverse, complex and dynamic community of microbes representing over 1000 different species, which continuously interact with the host. The homeostasis of the gut microbiota is dependent on host characteristics (age, gender, genetic background . . . ) and environmental conditions (stress, drugs, gastrointestinal surgery, infectious and toxic agents . . . ), but also on the day-to-day dietary changes.

It has been recently acknowledged that the intestinal microbiota is involved in a number of diseases. For instance, gut microbiota imbalance was shown to be a risk factor for the development of cancers such as colorectal cancer. Growing evidences also support the role of gut microbiota in the development of obesity and related disorders, brain disorders and intestinal inflammation, or intestinal pain.

Therefore, treatment with products that target the gut microbiota appeared as promising therapeutic tools for treating a broad range of disorders. These products may consist of living microbes, such as in the case of most probiotics, or contain dead microbes or fragments thereof. In addition, these products may comprise substrates that are used by the gut microbiota, such as in the case of prebiotics, or contain compounds that change the balance of the intestinal microbiota, such as specific antimicrobial compounds. For example, WO 2008/076696 describes the gut microbiota as a therapeutic target for treating obesity and related disorders. WO 2008/076696 specifically describes methods for altering the abundance of Bacteroidetes and/or Firmicutes in the gut of a subject, by administering antibiotics and/or probiotics to the subject. Moreover, EP 2 030 623 relates to the prevention and/or treatment of metabolic disorders, such as, for example, obesity related disorders, by regulating the amount of Enterobacteria in the gut. EP 2 030 623 discloses reducing the amount of Enterobacteria in the gut by administering probiotic bacteria, such as, for example, *Bifidobacterium*, *Lactococcus*, *Streptococcus*, *Enterococcus* or *Lactobacillus*.

However, there is still a need for other products, for example derived from the gut microbiota, with a therapeutic potential for treating microbiota related diseases.

Clostridial cluster IV is a phenotypically heterogeneous group that includes motile as well as non-motile species, sporulating as well as non-sporulating bacteria and Gram-staining positive, negative or variable species. The majority of them are anaerobic rods isolated from or at least encountered in the digestive tract of various animals, for example *corbicula* claims with *Oscillibacter valericigenes*, cattle with *Oscillibacter ruminantium*, wood-feeding termite with *Sporobacter termitidis*, cat with Agathobaculum *desmolans* and human with *Clostridium leptum*, *Faecalibacterium prausnitzii* or *Papillibacter cinnamivorans*. Several of them, *F. prausnitzii* and *Butyricicoccus pullicaecorum* in particular, are major butyrate producers in the gastrointestinal tract and have demonstrated health-promoting properties (Sokol et al., Proc Natl Acad Sci USA. 2008 Oct. 28; 105(43): 16731-6; Eeckhaut et al., Gut. 2013 December; 62(12): 1745-52). Others are suspected to have beneficial properties due to their regular association with health-related parameters in cultivation-independent studies. This is the case of *Oscillospira guilliermondii*, which is positively associated with leanness and negatively associated with inflammatory bowel disease and liver disease (Konikoff et al., Trends Microbiol. 2016 July; 24(7):523-524).

The absence of cultivable isolated strains representative of those taxa hinders a better understanding of the physiology of those bacteria and the demonstration of their causal impact on animal health.

In the present invention, the applicants were able to isolate and cultivate a novel bacterial strain, J115, from a fecal sample of a healthy 25 years old female, in an effort to identify potential new beneficial microbes isolated from the human gut. Strain J115 represents the type strain of a novel species, *Dysosmobacter welbionis*, itself the type species of a new genus, *Dysosmobacter*, whose identification has opened the way for its use in the treatment of gastrointestinal microbiota related disorders. Surprisingly, the applicants herein demonstrated that this novel bacterial species, when administered in vivo, presents a therapeutic potential for treating diseases related to the gut microbiota, as well as a cosmetic potential, such as, for example, for inducing weight loss.

The present invention thus relates to bacterial cells of the *Dysosmobacter* genus, and to the use thereof in therapeutic or cosmetic methods.

SUMMARY

The present invention relates to an isolated bacterium belonging to the genus *Dysosmobacter* and/or a variant thereof and/or fragments thereof.

In one embodiment, the bacterium according to the invention belongs to the species *Dysosmobacter welbionis* and/or a variant thereof.

In one embodiment, the nucleotide sequence of the 16S rRNA gene of the isolated bacterium of the invention has at least about 90% identity with SEQ ID NO: 1.

In one embodiment, the isolated bacterium according to the invention is able to ferment myo-inositol.

In one embodiment, the isolated bacterium according to the invention is the strain J115, deposited at the BCCM/LMG on Mar. 14, 2018 as LMG P-30603, and/or a variant thereof.

In one embodiment, the isolated bacterium according to the invention is pasteurized.

In one embodiment, the isolated bacterium according to the invention is frozen.

The present invention also relates to a composition comprising an isolated bacterium according to the invention, and/or fragments thereof.

The present invention also relates to a pharmaceutical composition comprising the composition according to the invention, and at least one pharmaceutically acceptable excipient.

The present invention also relates to a nutraceutical composition comprising the composition according to the invention, and at least one nutraceutically acceptable excipient.

The present invention also relates to a cosmetic composition comprising the composition according to the invention and at least one cosmetically acceptable excipient.

The present invention also relates to the isolated bacterium, the composition or the pharmaceutical composition according the invention, for use as a medicament.

The present invention also relates to the isolated bacterium, the composition or the pharmaceutical composition according to the invention, for use in treating a disorder related to the gastrointestinal microbiota in a subject in need thereof.

In one embodiment, the disorder related to the gastrointestinal microbiota is a metabolic disease, preferably selected from the list comprising obesity, metabolic syndrome, insulin-deficiency or insulin-resistance related disorders, Diabetes Mellitus, glucose intolerance, abnormal lipid metabolism, hyperglycemia, dyslipidemia, high cholesterol, elevated LDL-cholesterol, decreased HDL-cholesterol and elevated triglycerides The present invention also relates to the use of the isolated bacterium, the composition, the nutraceutical composition or the cosmetic composition according to the invention, for promoting weight loss, decreasing food intake, increasing muscle mass, decreasing fat mass, increasing satiety, and/or decreasing weight gain associated with food intake in a subject.

DETAILED DESCRIPTION

Figure 1:
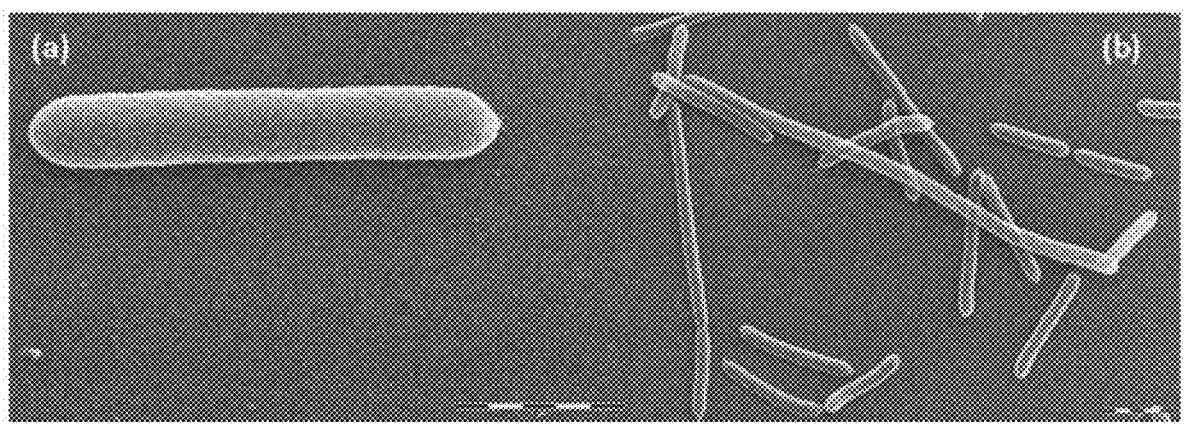
FIG. 1 shows scanning electron micrographs of cells of strain J115 in exponential phase. (a) 50 000 magnification, scale bar=1 μm (b) 10 000 magnification, scale bar=2 μm.

In the present invention, the following terms have the following meanings:

"About" preceding a figure means plus or less 10% of the value of said figure.

"Acceptable", for example when used in the expressions "Pharmaceutically acceptable", "Nutraceutically acceptable" and "Cosmetically acceptable" refers to molecular entities and compositions that do not produce an adverse, allergic or other untoward reaction when administered to a subject, especially a human, as appropriate.

"Bacterial strain" refers to a subtype of a bacterial species.

"*Clostridium* cluster IV" refers to a phenotypically heterogeneous group that includes motile as well as non-motile species, sporulating as well as non-sporulating bacteria and Gram-staining positive, negative or variable species. The majority of them are anaerobic rods isolated from or at least encountered in the digestive tract of various animals, for example *corbicula* clams with *Oscillibacter valericigenes*, cattle with *Oscillibacter ruminantium*, wood-feeding termite with *Sporobacter termitidis*, cat with Agathobaculum *desmolans* and human with *Clostridium leptum, Faecalibacterium prausnitzii* or *Papillibacter cinnamivorans*. Several of them, *F. prausnitzii* and *Butyricicoccus pullicaecorum* in particular, are major butyrate producers in the gastrointestinal tract and have demonstrated health-promoting properties. Others are suspected to have beneficial properties due to their regular association with health-related parameters in cultivation-independent studies. This is the case of *Oscillospira guilliermondii*, which is positively associated with leanness and negatively associated with inflammatory bowel disease and liver disease.

"Cosmetically effective amount" refers to the amount of a cosmetic composition necessary and sufficient for promoting a cosmetic effect, such as, for example, for inducing weight loss in a subject.

"*Dusodibacter*" [dy.so.di.bac'ter. a Gr. n. dusôdía putrescent, fetid smell; N.L. masc. n. bacter rod; N.L. masc. n. a rod producing a fetid smell] and "*Dysosmobacter*" [Dys.os.mo.bac'ter. Gr. masc. adj. dysosmos bad smelling; N.L. masc. n. bacter a rod; N.L. masc. n. *Dysosmobacter* a bad-smelling rod] are used interchangeably to refers to a new genus of bacteria described herein that have the following properties: cells are obligatory anaerobic, non-pigmented, non-spore-forming, non-motile, Gram-stain-negative. Cells form straight rods mainly 1.8-3.0 μm but often form elongated rods up to 20 μm whatever the growing phase. No respiratory menaquinones are produced. The genus belongs to the family of Ruminococcaceae. The type species is *Dysosmobacter welbionis*. In one embodiment, the diagnostic diamino acid in the cell wall is meso-2,6-diaminopimelic acid.

"*Dusodibacter welbiota*" [u'ɛl.bi'o.ta. *welbiota*] and "Dysosinobacter *welbionis*" [wel.bi.o'nis. N.L. gen. n. *welbionis*] are used interchangeably to refer to a new species of bacteria described herein that have the following properties in addition to the properties of the genus *Dysosmobacter* described hereinabove: colonies on solid modified YCFA after 72 h of incubation at 37° C. under anaerobic conditions are punctiform, cream, translucent, circular, entire, slightly convex and smooth. Growth is inhibited by the presence of 2% w/v bile or 2% w/v NaCl. Aesculin is not hydrolysed. Indole is not produced. Nitrate is not reduced. Gelatin is not digested. Urease is not produced. Catalase is not produced. Acid is produced from myo-inositol but not from D-glucose, D-arabinose, D-ribose and D-xylose. Positive reactions are obtained for arginine dihydrolase and glutamic acid decarboxylase. All the other tests from API 20A and Rapid ID 32A (bioMérieux, Lyon, France) are negative. Major fermentation end-products from myo-inositol are butyrate. The DNA GC content of the type strain is 59.3 mol % by High Performance Liquid Chromatography (HLPC). In one embodiment, the DNA GC content of the type strain is 58.9 mol % on the basis the genomic sequence. Type strain is J115 (deposited at the BCCM/LMG on Mar. 14, 2018 as LMG P-30603) and was isolated from human faeces. In one embodiment, the major cellular fatty acids are saturated branched-chain fatty acids and DMAs. In one embodiment, the major DMA fatty acid is $C_{18:0}$ DMA and major saturated branched-chain fatty acids are iso-$C_{15:0}$ and anteiso-$C_{15:0}$.

"Fermentation" refers to the metabolic process that consumes sugar in the absence of oxygen. The products are organic acids, gases, or alcohol. It occurs in yeast and bacteria, and also in oxygen-starved muscle cells, as in the case of lactic acid fermentation.

"Gastrointestinal microbiota related disorder" or "gastrointestinal microbiota related disease" are used interchangeably to refer to a group of diseases or disorders that are related to an imbalance, a deficiency or an excess in the composition of a subject gastrointestinal microbiota and/or product thereof. Example of disorders related to the gastrointestinal microbiota include, but are not limited to metabolic diseases such as for example, obesity, metabolic syndrome, insulin-deficiency or insulin-resistance related disorders, Diabetes Mellitus (such as, for example, Type 2 Diabetes), glucose intolerance, hyperglycemia, abnormal lipid metabolism, dyslipidemia, high cholesterol, elevated LDL-cholesterol, decreased LDL cholesterol and elevated triglycerides, infections, colitis, such as for example, inflammatory bowel disease (e.g., Crohn's disease and ulcerative colitis), ischemic colitis, irritable bowel syndrome, lymphocytic colitis and collagenous colitis, cancers, such as for example, colorectal cancer, dysfunction of the immune system, such as for example, eczema, allergies, food allergies and celiac disease, psychological disorders, such as for example, stress, anxiety and addiction, neurological disorders, such as for example, Parkinson's disease and Alzheimer's disease, liver diseases, such as for example, cirrhosis, non-alcoholic fatty liver disease, and hepatic steatosis, cachexia, prader-willy syndrome, dysfunction of the digestive tract, such as for example, ulcers and gallbladder disease, feeding behaviors disorders such as for example, anorexia nervosa, bulimia nervosa and binge-eating disorder, cardiovascular diseases and conditions, such as for example strokes, atherosclerosis and hypertension, asthma, sleep apnea and osteoarthritis.

"Gut microbiota" or "gastrointestinal microbiota" are used interchangeably to refer to the complex community of microorganisms that live in the digestive tracts of humans and other animals. The composition of the gastrointestinal microbiota changes over the lifetime of the host organism or when the diet of the host changes. It also varies across the digestive tract. The digestive tract contains a densely-populated microbial ecosystem with up to $10^{12}$ cells per gram of intestinal content. Many species in the gut have not been studied outside of their hosts because most cannot be cultured. The four dominant bacterial phyla in the human gut are Firmicutes, Bacteroidetes, Actinobacteria, and Proteobacteria. Most bacteria belong to the genera *Bacteroides, Clostridium, Faecalibacterium, Eubacterium, Ruminococcus, Peptococcus, Peptostreptococcus, Blautia, Subdoligranulum, Alistipes, Coprococcus, Dialister,* Lachnoclostridium, *Oscillospira, Parabacteroides, Prevotella, Roseburia,* Ruminiclostridium, *Sutterella* and *Bifidobacterium*. Other genera, such as *Escherichia, Enterococcus, Barnesiella, Butyricimonas, Butyricicoccus, Lachnospira, Odoribacter, Turicibacter* and *Lactobacillus*, are present to a lesser extent. The gut microbiota is thought to function in the defense again pathogens, by competing with potential pathogens and by participating in the development of enteric protection and the immune system, metabolism, by assisting the digestion of consumed aliments, aiding the absorption of nutrients and synthetizing vitamins. The gut microbiota also interacts with the function of the central nervous system and the neuroendocrine and neuroimmune systems.

"Menaquinones" refers to components of the bacterial respiratory chain that play an important role in electron transfer during microbial respiration.

"Mutant", as used herein, refers to a biological entity which has undergone a natural or induced (i.e. by mutagenesis) change in its genetic structure that does not interfere with the defining properties of said biological entity. The change in its genetic structure may be an insertion or deletion or substitution of one or several nucleotides in the genomic sequence. For example, a *Dysosmobacter welbionis* mutant refers to a *Dysosmobacter welbionis* strain which has undergone a change, natural or by techniques of genetic engineering, in its genetic structure that does not interfere with its belonging to the *Dysosmobacter welbionis* species.

"Nutraceutically effective amount" refers to the amount of a nutraceutical composition, food or dietary supplement or functional food necessary and sufficient for providing a physiological benefit or alleviating a discomfort in a subject.

"Pasteurized bacterium" refers to a bacterium submitted to a heat treatment (or heating process).

"Pharmaceutically acceptable carrier or excipient" refers to molecular entities and compositions that do not produce an adverse, allergic or other untoward reaction when administered to a subject, especially a human, as appropriate. It includes any and all solvents, dispersion media, coatings, antibacterial and antifungal agents, isotonic and absorption delaying agents and the like. For human administration, preparations should meet, pyrogenicity, general safety and purity standards as required by regulatory offices, such as, for example, FDA Office or EMA. A pharmaceutically acceptable carrier or excipient may thus refer to a non-toxic solid, semi-solid or liquid filler, diluent, encapsulating material or formulation auxiliary of any type.

"Prebiotic" refers to a substance, which may not be digested by a subject (such as, for example, by humans), but which modulates composition and/or activity of the gut microbiota through its metabolization by microorganisms in the gut, thus conferring a beneficial physiological effect on the host.

"Probiotics" refers to microbial cell preparations (such as, for example, living microbial cells) which, when administered in an effective amount, provide a beneficial effect on the health or well-being of a subject. By definition, all probiotics have a proven non-pathogenic character. In one embodiment, these health benefits are associated with improving the balance of human or animal microbiota in the gastro-intestinal tract, and/or restoring normal microbiota.

"Subject" refers to a warm-blooded animal, preferably a human, a pet or livestock. As used herein, the terms "pet" and "livestock" include, but are not limited to, dogs, cats, guinea pigs, rabbits, pigs, cattle, sheep, goats, horses and poultry. In some embodiments, the subject is a male or female subject. In some embodiments, the subject is an adult or a child. In some embodiments, the subject may be a "patient", i.e., a subject who/which is awaiting the receipt of or is receiving medical care or was/is/will be the object of a medical procedure according to the methods of the present invention or is monitored for the development of a disease.

"Substantially healthy subject" is used to define a subject which is not affected by the disease to be treated or by the discomfort to be alleviated. For example, if the bacterium of the invention or a fragment thereof is used for treating obesity, the substantially healthy subject is not affected by obesity. Preferably, the substantially healthy subject shares common characteristics with the subject to be treated, such as, for example, same gender, age, sex, diet, drugs intake or geolocation.

"Therapeutically effective amount" refers to the level or amount of an agent that is aimed at, without causing significant negative or adverse side effects to the target, (1) delaying or preventing the onset of a disease, disorder, or condition; (2) slowing down or stopping the progression, aggravation, or deterioration of one or more symptoms of the disease, disorder, or condition; (3) bringing about ameliorations of the symptoms of the disease, disorder, or condition; (4) reducing the severity or incidence of the disease, disorder, or condition; or (5) curing the disease, disorder, or condition. A therapeutically effective amount may be administered prior to the onset of the disease, disorder, or condition, for a prophylactic or preventive action. Alternatively, or additionally, the therapeutically effective amount may be administered after initiation of the disease, disorder, or condition, for a therapeutic action.

"Treatment" refers to both therapeutic treatment and prophylactic or preventative measures wherein the object is to prevent or slow down (lessen) the targeted pathologic condition or disorder. Those in need of treatment include those already with the disorder as well as those prone to have the disorder or those in whom the disorder is to be prevented. A subject or mammal is successfully "treated" if, after receiving a therapeutic amount of *Dysosmobacter welbionis* and/or a variant thereof and/or a fragment thereof according to the present invention the patient shows one or more of the following observable and/or measurable changes: amelioration related to one or more of the symptoms associated with the specific disease or condition, reduction of morbidity and mortality and improvement in quality of life issues. The above parameters for assessing successful treatment and improvement in the disease are readily measurable by routine procedures familiar to a physician.

"Type strain" refers to as defined in the International Code of Nomenclature of Bacteria, as the nomenclatural type of the species and the reference point to which all other strains are compared to know whether they belong to that species. For example, strain J115, isolated from a faecal sample of a healthy 25 years old female, is the type strain of the species *Dysosmobacter welbionis*.

"Variant" refers to all the genetically or phenotypically distinct strains of a species that retain the species-defining characteristics. The term variant is also used in reference to other phylogenetic taxa such as for a genus or for a strain. As used herein, the term "variant" refers to both naturally occurring and specifically developed variants or mutants of the bacterium disclosed and exemplified herein. In one embodiment, variants may or may not have the same identifying biological characteristics of the bacterium exemplified herein, provided they share similar advantageous properties in terms of treating or preventing diseases. In one embodiment, a variant of the bacterium of the invention has the same functional and/or therapeutic properties as the bacterium of the invention. Illustrative examples of suitable methods for preparing variants of the microbial strains exemplified herein include, but are not limited to, gene integration techniques such as those mediated by insertion of elements or transposons or by homologous recombination, other recombinant DNA techniques for modifying, inserting, deleting, activating or silencing genes, intraspecific protoplast fusion, mutagenesis by irradiation with ultraviolet light or X-rays, or by treatment with a chemical mutagen such as nitrosoguanidine, methyl methane sulfonate, nitrogen mustard and the like, and bacteriophage—mediated transduction. Suitable and applicable methods are well known in the art and are described, for example, in J. H. Miller, Experiments in Molecular Genetics, Cold Spring Harbor Laboratory Press, Cold Spring Harbor, N.Y, (1972); J, H. Miller, A Short Course in Bacterial Genetics, Cold Spring Harbor Laborator Press, Cold Spring Harbor, N.Y. (1992); and J. Sambrook, D. Russell, Molecular Cloning: A Laboratory Manual, 3rd ed., Cold Spring Harbor Laboratory Press, Cold Spring Harbor, N. Y. (2000» inter alia.

The present invention first relates to a bacterium (or to a bacterial cell) belonging to the genus *Dysosmobacter*. Following a nomenclature change, the genus is also known as *Dysosmobacter*. Both terms are equivalent and interchangeable throughout the present application. Should the taxonomy change again, the skilled artisan would know how to adapt the changes in the taxonomy to deduce the bacteria that could be used in the present invention.

Bacteria belonging to the genus *Dysosmobacter* are described for the first time herein by the Inventors. The genus *Dysosmobacter* belongs to the family Ruminococcaceae. In one embodiment, bacteria belonging to the genus *Dysosmobacter* have the following characteristics: cells are anaerobic; not pigmented; non-spore-forming; non-motile, Gram stain-negative; cells form rods, e.g., straight rods (such as, for example, about 1.8 to 3 µm long) or elongated rods; cells do not produce respiratory menaquinones; at least about 10%, preferably at least about 20%, more preferably about 30% of cellular fatty acids are saturated branched-chain fatty acids and DMA fatty acid; C18:0 DMA represents at least about 5%, preferably at least about 10%, more preferably about 15% of cellular fatty acids; iso-$C_{15:0}$ represents at least about 10%, preferably at least about 15%, more preferably about 20% of cellular fatty acids; and anteiso-$C_{15:0}$ represent at least about 5%, preferably at least about 7.5%, more preferably about 10% of cellular fatty acids. In one embodiment, the diagnostic diamino acid in the cell wall of bacteria belonging to the genus *Dysosmobacter* is meso-2,6-diaminopimelic acid.

The sequence of the 16S rRNA gene of *Dysosmobacter welbionis* strain J115, SEQ ID NO: 1 has been deposited under the GenBank/EMBL/DDBJ accession number MG963288.

The sequence of the 16S rRNA gene is often used to identify different bacterial species because of the mutation accumulating in its hyper-variable regions and the presence of the gene in all bacteria.

In one embodiment, the nucleotide sequence of the 16S rRNA gene of the bacterium of the invention has the sequence SEQ ID NO: 1, or has a sequence presenting at least about 90% identity with SEQ ID NO: 1, preferably at least about 91%, 92%, 93%, 94%, 95%, 96%, 96.5%, 97%, 97.5%, 97.6%, 97.7%, 97.8%, 97.9%, 98.0%, 98.1%, 98.2%, 98.3%, 98.4%, 98.5%, 98.6%, 98.65%, 98.7%, 98.8%, 98.9%, 99%, 99.1%, 99.2%, 99.3%, 99.4%, 99.5%, 99.6%, 99.7%, 99.8%, 99.9% or more identity with SEQ ID NO: 1.

In one embodiment, the nucleotide sequence of the 16S rRNA gene of the bacterium of the invention has the sequence SEQ ID NO: 1, or has a sequence presenting at least about 99.9% identity with SEQ ID NO: 1, preferably at least about 99.91%, 99.92%, 99.93%, 99.94%, 99.95%, 99.96%, 99.97%, 99.98%, 99.99%, or more identity with SEQ ID NO: 1.

In one embodiment, the nucleotide sequence of the 16S rRNA gene of the bacterium of the invention has the sequence SEQ ID NO: 1, or has a sequence presenting at least about 90% identity or more identity over the entire length of SEQ ID NO: 1, preferably at least about 91%, 92%, 93%, 94%, 95%, 96%, 96.5%, 97%, 97.5%, 97.6%, 97.7%, 97.8%, 97.9%, 98.0%, 98.1%, 98.2%, 98.3%, 98.4%, 98.5%, 98.6%, 98.65%, 98.7%, 98.8%, 98.9%, 99%, 99.1%, 99.2%, 99.3%, 99.4%, 99.5%, 99.6%, 99.7%, 99.8%, 99.9%, 99.91%, 99.92%, 99.93%, 99.94%, 99.95%, 99.96%, 99.97%, 99.98%, 99.99%, or more identity over the entire length of SEQ ID NO: 1.

The term "identity" when used in a relationship between the sequences of two or more polypeptides or of two or more nucleic acid molecules, refers to the degree of sequence relatedness between polypeptides or nucleic acid molecules, as determined by the number of matches between strings of two or more amino acid or nucleotide residues. "Identity" measures the percent of identical matches between the smaller of two or more sequences with gap alignments (if any) addressed by a particular mathematical model or computer program (i.e., "algorithms"). Identity of related polypeptides can be readily calculated by known methods. Such methods include, but are not limited to, those described in Computational Molecular Biology, Lesk, A. M., ed., Oxford University Press, New York, 1988; Biocomputing: Informatics and Genome Projects, Smith, D. W., ed., Academic Press, New York, 1993; Computer Analysis of Sequence Data, Part 1, Griffin, A. M., and Griffin, H. G., eds., Humana Press, New Jersey, 1994; Sequence Analysis in Molecular Biology, von Heinje, G., Academic Press, 1987; Sequence Analysis Primer, Gribskov, M. and Devereux, J., eds., M. Stockton Press, New York, 1991; and Carillo et al., SIAM J. Applied Math. 48, 1073 (1988). Preferred methods for determining identity are designed to give the largest match between the sequences tested. Methods of determining identity are described in publicly available computer programs. Preferred computer program methods for determining identity between two sequences include the GCG program package, including GAP (Devereux et al., Nucl. Acid. Res. \2, 387 (1984); Genetics Computer Group, University of Wisconsin, Madison, Wis.), BLASTP, BLASTN, and FASTA (Altschul et al., J. Mol. Biol. 215, 403-410 (1990)). The BLASTX program is publicly available from the National Center for Biotechnology Information (NCBI) and other sources (BLAST Manual, Altschul et al. NCB/NLM/NIH Bethesda, Md. 20894; Altschul et al., supra). The well-known Smith Waterman algorithm may also be used to determine identity. In one embodiment, the term identity is measured over the entire length of the sequence to which it refers.

In one embodiment, the bacterium of the invention belongs to the species *Dysosmobacter welbionis*. Following a nomenclature change, the species is also known as *Dusodibacter welbiota*. Both terms are equivalent and interchangeable throughout the present application.

In one embodiment, bacteria belonging to the species *Dysosmobacter welbionis*, described for the first time herein by the Inventors, have, in addition to the characteristic described hereinabove of the genus *Dysosmobacter*, the following characteristics: colonies forming on solid modified YCFA medium after 72 h of incubation at 37° C. under anaerobic conditions are punctiform, cream, translucent, circular, entire, slightly convex and smooth. In one embodiment, bacterial growth is inhibited by a concentration of bile in the medium at or above about 1% w/v, preferably about 2% w/v and/or by a concentration of NaCl in the medium at or above about 1% w/v, preferably about 2% w/v. In one embodiment, cells do not have catalase activity. In one embodiment, cells have arginine dihydrolase and/or glutamic acid decarboxylase activity.

In one embodiment, the bacterium of the invention is able to ferment myo-inositol.

In one embodiment, the bacterium of the invention is unable to ferment D-glucose, D-ribose, D-arabinose and D-Xylose.

In one embodiment, the bacterium of the invention is unable to ferment D-glucose and/or D-Xylose.

Techniques to determine the substrates that a bacterium is able to ferment are known to the person skilled in the art. For example, this characterization can be done using anaerobe test kit such as the test API 50CH (BioMérieux, Lyon, France).

In one embodiment, at least 1, preferably at least 2, 3, 4, 5, 6, 8, 9, 10, 11, 12, 13, 14, 15, 16, 17, 18, 19 or 20 tests from the anaerobe test kit API20A (BioMerieux, Lyon, France) are negative.

The anaerobe test kit API20A (BioMérieux, Lyon, France) allows the biochemical characterization of anaerobe bacteria by enabling 20 biochemical tests, namely urease activity, indole production, gelatin hydrolysis, esculin hydrolysis, fermentation of D-glucose, D-mannitol, D-lactose, D-saccharose, D-maltose, salicin, D-xylose, L-arabinose, glycerol, D-cellobiose, D-mannose, D-melezitose, D-raffinose, D-sorbitol, L-rhamnose and D-trehalose.

In one embodiment, at least 1, preferably at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31 or 32 tests from the anaerobe test kit API32A (BioMérieux, Lyon, France) are negative.

The rapid ID32A (BioMérieux, Lyon, France) allows the biochemical characterization of anaerobe bacteria by enabling 32 biochemical tests, namely urease, arginine dihydrolase, α-galactosidase, β-galactosidase, β-galactosidase-6-phosphate, α-glucosidase, α-arabinosidase, β-glucuronidase, N-acetyl-glucosaminidase, glutamic acid decarboxylase, α-fucosidase, alkaline phosphatase, arginine arylamidase, proline arylamidase, leucyl glycine arylamidase, phenylalanine arylamidase, leucine arylamidase, pyroglutamic acid arylamidase, tyrosine arylamidase, alanine arylamidase, glycide arylamidase, histidine arylamidase, glutamic acid glutamyl arylamidase and serine arylamidase enzymatic activities as well as nitrate reduction, indole production and mannose and raffinose fermentation.

In one embodiment, the bacterium of the invention is not motile. In one embodiment, the bacterium of the invention has no flagellum.

In one embodiment, the bacterium of the invention is the strain J115 (deposited at the BCCM/LMG on Mar. 14, 2018 as LMG P-30603). The J115 strain is the type strain of the species *Dysosmobacter welbionis* (previously referred to as *Dusodibacter welbiota*).

In one embodiment, the GC content in the genome of the bacterium of the invention ranges from about 50 to about 70%, preferably ranges from about 55 to 65%, more preferably is of about 59%.

Methods for determining the GC content (i.e. the proportion of Guanine-Cytosine in a DNA sequence) of a genome are well known to a person skilled in the art and include, but are not limited to, whole genome sequencing, High-Pressure Liquid Chromatography, DNA melting temperature analysis, and Flow cytometry.

The genome sequence of *Dysosmobacter welbionis* strain J115, SEQ ID NO: 10, has been deposited under the GenBank/EMBL/DDBJ accession number CP034413.

In one embodiment, the genome sequence of the bacterium of the invention has the sequence SEQ ID NO: 10, or has a sequence presenting at least about 65% identity with SEQ ID NO: 10, preferably at least about 70%, 75%, 80%, 85%, 90% identity with SEQ ID NO: 10, more preferably at least about 91%, 92%, 93%, 94%, 95%, 96%, 96.5%, 97%, 97.5%, 97.6%, 97.7%, 97.8%, 97.9%, 98.0%, 98.1%, 98.2%, 98.3%, 98.4%, 98.5%, 98.6%, 98.65%, 98.7%, 98.8%, 98.9%, 99%, 99.1%, 99.2%, 99.3%, 99.4%, 99.5%, 99.6%, 99.7%, 99.8%, 99.9% or more identity with SEQ ID NO: 10.

In one embodiment, the bacterium of the invention has an Average Nucleotide Identity (ANI) score above about 60, preferably above about 74, 75, 80, 85, 90, more preferably above about 95, even more preferably above about 96, 97, 98, 98.5, 98.65, 99 or more when compared to the genome of sequence SEQ ID NO: 10.

Techniques to determine the ANI value are known to the person skilled in the art (such as, for example, methods implemented in Kim et al., Int J Syst Evol Microbiol. 2014 February; 64(Pt 2):346-51). Briefly, ANI correspond to corresponds to the sum for each bidirectional best hit (BBH—orthologs sequences identified on the basis of their position in the genome and sequence identity) of the identity multiplied by the length of the alignment divided by the total length of BBH genes.

In one embodiment, the bacterium of the invention of the invention has a hybrid DNA-DNA hybridization value (also referred to as DDH value) with SEQ ID NO: 10 above about 60%, preferably above about 61%, 62%, 63%, 64%, 65%, 66%, 67%, 68%, 69%, more preferably above about 70%.

Techniques to determine a DDH value are known to the person skilled in the art (such as, for example, methods reviewed by Rossello-Móra, in Stackebrandt et al., Molecular Identification, Systematics, and Population Structure of Prokaryotes, p23-50, 2006, Springer, Berlin, Heidelberg) and rely on the following general principle: (i) shearing the genomic DNA (gDNA) of the assayed organism and the gDNA of the reference organism(s) (for instance in the context of the present invention the type strain J115 (deposited at the BCCM/LMG on Mar. 14, 2018 as LMG P-30603) into small fragments of 600-800 bp; (ii) heating the mixture of DNA fragments from both strains to dissociate the DNA double-strands; and (iii) subsequently decreasing the temperature until the fragments reanneal. For the reason that the melting temperature of a double-strand depends on the degree of matching base pairings between both strands, genomic (dis-) similarity can be inferred from the melting temperature. The hybrid DDH value is usually specified relative to the DDH value obtained by hybridizing a reference genome with itself. DDH values ≤70% may be considered as an indication that the tested organism belongs to a different species than the type strain used as reference. The DDH value may also evaluated on the basis of the genomic sequence of the strains to be compared using in publicly available computer programs such as for example using method described in Meier-Kolthoff et al. (BMC Bioinformatics. 2013 Feb. 21; 14:60).

In one embodiment, the bacterium of the invention has an intergenome distance with SEQ ID NO: 10, below about 0.5, preferably below about 0.22, 0.21, 0.20, 0.19, 0.18, 0.17, 0.16, 0.15, 0.14 more preferably bellow about 0.13, 0.12, 0.11, 0.10, or less.

Techniques to determine the intergenome distance, or genome-genome distance (GGD), are known to the skilled artisan. For example, methods described by Meier-Kolthoff et al. (BMC Bioinformatics 2013; 21:14-60; Int J Syst Evol Microbiol 2014; 1:352-6) may be used. Such method may be implemented using the genome calculator 2.1 (Deutsche Sammlung von Mikroorganismen and Zellkulturen-DSMZ) using BLAST+ as a local alignment tool and the sum of all identities found in high-scoring segment pairs (HSP) divided by overall HSP length.

The invention also relates to variants of the bacterium of the invention described hereinabove. Said variant may also be referred as a derived strain of the bacterium of the invention. In one embodiment, the variant of the bacterium of the invention may be obtained by mutation, variation or recombination of the bacterium described herein. In the present invention, a variant of a bacterium of the invention may also be referred to as a mutant of a bacterium of the invention.

In one embodiment, the variant of the bacterium of invention is a variant of *Dysosmobacter welbionis*.

In one embodiment, the variant of the bacterium of the invention is a variant of strain J115 (deposited at the BCCM/LMG on Mar. 14, 2018 as LMG P-30603).

In one embodiment, a variant of the bacterium of the invention has a genome at least about 70%, preferably at least about 80%, at least about 90%, at least about 91%, 92%, 93%, 94%, 95%, 96%, 97%, 98%, 99%, 99.5%, 99.8%, or more identical to the genome of the bacterium from which it derives.

In one embodiment, the genome sequence of a variant of the bacterium of the invention has at least about 65% identity with sequence of the genome of the bacterium from which it derives, preferably at least about 70%, 75%, 80%, 85%, 90% identity with sequence of the genome of the bacterium from which it derives, more preferably at least about 91%, 92%, 93%, 94%, 95%, 96%, 96.5%, 97%, 97.5%, 97.6%, 97.7%, 97.8%, 97.9%, 98.0%, 98.1%, 98.2%, 98.3%, 98.4%, 98.5%, 98.6%, 98.65%, 98.7%, 98.8%, 98.9%, 99%, 99.1%, 99.2%, 99.3%, 99.4%, 99.5%, 99.6%, 99.7%, 99.8%, 99.9%, or more, identity with the sequence of the genome of the bacterium from which it derives.

In one embodiment, the genome sequence of a variant of the bacterium of the invention has at least about 65% identity with SEQ ID NO: 10, preferably at least about 70%, 75%, 80%, 85%, 90% identity with SEQ ID NO: 10, more preferably at least about 91%, 92%, 93%, 94%, 95%, 96%, 96.5%, 97%, 97.5%, 97.6%, 97.7%, 97.8%, 97.9%, 98.0%, 98.1%, 98.2%, 98.3%, 98.4%, 98.5%, 98.6%, 98.65%, 98.7%, 98.8%, 98.9%, 99%, 99.1%, 99.2%, 99.3%, 99.4%, 99.5%, 99.6%, 99.7%, 99.8%, 99.9%, or more, identity with SEQ ID NO: 10.

In one embodiment, a variant of the bacterium of the invention has a 16S rRNA gene sequence having at least about 90% identity with the 16S rRNA gene of the bacterium from which it derives, preferably at least about 91%, 92%, 93%, 94%, 95%, 96%, 96.5%, 97%, 97.5%, 97.6%, 97.7%, 97.8%, 97.9%, 98.0%, 98.1%, 98.2%, 98.3%, 98.4%, 98.5%, 98.6%, 98.65%, 98.7%, 98.8%, 98.9%, 99%, 99.1%, 99.2%, 99.3%, 99.4%, 99.5%, 99.6%, 99.7%, 99.8%, 99.9%, or more, identical to the sequence of the 16S rRNA gene of the bacterium from which it derives.

In one embodiment, a variant of the bacterium of the invention has a 16S rRNA gene sequence having at least about 99.9% identity with the 16S rRNA gene of the bacterium from which it derives, preferably at least about 99.91%, 99.92%, 99.93%, 99.94%, 99.95%, 99.96%, 99.97%, 99.98%, 99.99%, or more, identical to the sequence of the 16S rRNA gene of the bacterium from which it derives.

In one embodiment, a variant of the bacterium of the invention has a 16S rRNA gene sequence having at least about 90% identity with SEQ ID NO: 1, preferably at least about 91%, 92%, 93%, 94%, 95%, 96%, 96.5%, 97%, 97.5%, 97.6%, 97.7%, 97.8%, 97.9%, 98.0%, 98.1%, 98.2%, 98.3%, 98.4%, 98.5%, 98.6%, 98.65%, 98.7%, 98.8%, 98.9%, 99%, 99.1%, 99.2%, 99.3%, 99.4%, 99.5%, 99.6%, 99.7%, 99.8%, 99.9%, or more, identical to SEQ ID NO: 1.

In one embodiment, a variant of the bacterium of the invention has a 16S rRNA gene sequence having at least about 99.9% identity with SEQ ID NO: 1, preferably at least about 99.91%, 99.92%, 99.93%, 99.94%, 99.95%, 99.96%, 99.97%, 99.98%, 99.99%, or more, identity with SEQ ID NO: 1.

In one embodiment, a variant of the bacterium of the invention has a 16S rRNA gene sequence having at least about 90% identity with SEQ ID NO: 1 over its entire length, preferably at least about 91%, 92%, 93%, 94%, 95%, 96%, 96.5%, 97%, 97.5%, 97.6%, 97.7%, 97.8%, 97.9%, 98.0%, 98.1%, 98.2%, 98.3%, 98.4%, 98.5%, 98.6%, 98.65%, 98.7%, 98.8%, 98.9%, 99%, 99.1%, 99.2%, 99.3%, 99.4%, 99.5%, 99.6%, 99.7%, 99.8%, 99.9%, 99.1%, 99.2%, 99.3%, 99.4%, 99.5%, 99.6%, 99.7%, 99.8%, 99.9%, 99.91%, 99.92%, 99.93%, 99.94%, 99.95%, 99.96%, 99.97%, 99.98%, 99.99%, or more, identity with SEQ ID NO: 1 over its entire length.

In one embodiment, a variant of the bacterium of the invention has a hybrid DNA-DNA hybridization value (also referred to as DDH value) above about 60%, preferably above about 61%, 62%, 63%, 64%, 65%, 66%, 67%, 68%, 69%, more preferably above about 70%.

In one embodiment, a variant of the bacterium of the invention has a hybrid DNA-DNA hybridization value (also referred to as DDH value) with the genome of the bacterium from which it derives above about 60%, preferably above about 61%, 62%, 63%, 64%, 65%, 66%, 67%, 68%, 69%, more preferably above about 70%.

In one embodiment, a variant of the bacterium of the invention has a hybrid DNA-DNA hybridization value (also referred to as DDH value) with SEQ ID NO: 10 above about 60%, preferably above about 61%, 62%, 63%, 64%, 65%, 66%, 67%, 68%, 69%, more preferably above about 70%.

In one embodiment, a variant of the bacterium of the invention has an Average Nucleotide Identity (ANI) value above about 60%, preferably above about 65%, 70%, 75%, 80%, 85%, 90%, more preferably above about 95%, even more preferably above about 96%.

In one embodiment, a variant of the bacterium of the invention has an Average Nucleotide Identity (ANI) score above about 60, preferably above about 74, 75, 80, 85, 90, more preferably above about 95, even more preferably above about 96, 97, 98, 98.5, 98.65, 99 or more when compared to the genome sequence of the bacterium from which it derives.

In one embodiment, a variant of a bacterium of the invention has an Average Nucleotide Identity (ANI) score above about 60, preferably above about 74, 75, 80, 85, 90, more preferably above about 95, even more preferably above about 96, 97, 98, 98.5, 98.65, 99 or more when compared to SEQ ID NO: 10.

In one embodiment, a variant of the bacterium of the invention has an intergenome distance with the genome of the bacterium from with derives, below about 0.5, preferably below about 0.22, 0.21, 0.20, 0.19, 0.18, 0.17, 0.16, 0.15, 0.14 more preferably bellow about 0.13, 0.12, 0.11, 0.10, or less.

In one embodiment, a variant of the bacterium of the invention has an intergenome distance with SEQ ID NO: 10, below about 0.5, preferably below about 0.22, 0.21, 0.20, 0.19, 0.18, 0.17, 0.16, 0.15, 0.14 more preferably bellow about 0.13, 0.12, 0.11, 0.10, or less.

In one embodiment, the GC content in the genome of a variant of the bacterium of the invention ranges from about 50 to about 70%, preferably ranges from about 55 to 65%, more preferably is of about 59%.

In one embodiment, a variant of the bacterium of the invention is able to ferment myo-inositol.

In one embodiment, a variant of the bacterium of the invention is unable to ferment D-glucose and/or D-Xylose.

In one embodiment, the diagnostic diamino acid in the cell wall of a variant of the bacterium of the invention is meso-2,6-diaminopimelic acid.

In one embodiment, a variant of the bacterium of the invention has the same function and/or therapeutic properties as the bacterium from which it derives.

In one embodiment, the bacterium of the invention and/or a variant thereof is a viable cell. In another embodiment, the bacterium of the invention and/or a variant thereof is a non-viable cell.

As used herein, the term "viable cells" refers to cells that are able to proliferate in opposition to non-viable cells that are not able to proliferate. Methods for measuring cell viability and proliferation are known to one skilled in the art. For example, cell viability and proliferation may be assessed by spreading a solution containing at least one bacterium of the invention across a petri dish and counting the number of colonies after a determined time of incubation in optimal growth conditions. Alternatively, cells may be grown in liquid medium, and proliferation may be measured by measuring optical density of the bacterial culture after a determined time of incubation in optimal growth conditions. It is also possible to determine the number of cells, including viable as well as non-viable cells by microscopic observation. While phase-contrast microscopy is a well-known method to do so, the microbial cells can be further visualized by specific staining with dyes, fluorescent probes or antibodies to facilitate microscopic observations or count cells by flow cytometry.

In one embodiment, the bacterium of the invention and/or a variant thereof is able to proliferate. In one embodiment, the bacterium of the invention and/or a variant thereof is alive. In one embodiment, the bacterium of the invention and/or a variant thereof is metabolically active.

In one embodiment, the bacterium of the invention and/or a variant thereof is fresh. The term "fresh" as used herein mean that the bacterium of the invention was not frozen between its last amplification phase and its use.

in one embodiment, the bacterium of the invention and/or a variant thereof is pasteurized. In one embodiment, the bacterium of the invention and/or a variant thereof is a pasteurized bacterium.

In one embodiment, the pasteurized bacterium of the invention and/or a variant thereof was heated at a temperature ranging from about 50° C. to about 100° C., preferably from about 60° C. to about 95° C., more preferably from about 70° C. to about 90° C. In one embodiment, the pasteurized bacterium of the invention and/or a variant thereof was heated at a temperature of about 50, 51, 52, 53, 54, 55, 56, 57, 58 or 59° C. In another embodiment, the pasteurized bacterium of the invention and/or a variant thereof was heated at a temperature of about 60, 61, 62, 63, 64, 65, 66, 67, 68 or 69° C. In yet another embodiment, the pasteurized bacterium of the invention and/or a variant thereof was heated at a temperature of about 70, 71, 72, 73, 74, 75, 76, 77, 78 or 79° C. In yet another embodiment, the pasteurized bacterium of the invention and/or a variant thereof was heated at a temperature of about 80, 81, 82, 83, 84, 85, 86, 87, 88 or 89° C. In yet another embodiment, the pasteurized bacterium of the invention and/or a variant thereof was heated at a temperature of about 90, 91, 92, 93, 94, 95, 96, 97, 98, 99° C. or 100° C.

In one embodiment, the pasteurized bacterium of the invention and/or a variant thereof was not heated at a temperature superior to about 100° C. In a particular embodiment, the pasteurized bacterium of the invention and/or a variant thereof was not heated at an ultra-high temperature, such as for example at a temperature ranging from about 110° C. to about 140° C. In one embodiment, the pasteurized bacterium of the invention and/or a variant thereof was not heated at a temperature superior to about 90° C. Accordingly, in one embodiment of the invention, the bacterium of the invention and/or a variant thereof was not sterilized. Sterilization is a treatment intended to destroy, kill or inactivate all life forms and other biological agents. This includes microorganisms and their spores as well as viruses and prions. Unlike sterilization, pasteurization is not intended to kill all microorganisms but is usually applied to food with the aim to reduce the number of viable pathogens.

In one embodiment of the invention, the pasteurized bacterium of the invention and/or a variant thereof was heated for at least about 10 minutes. In another embodiment of the invention, the pasteurized bacterium of the invention and/or a variant thereof was heated for at least about 15, 20, 25, 30, 35 or 45 minutes. In one embodiment, the pasteurized bacterium of the invention and/or a variant thereof was heated for a period from about 10 to about 45 minutes.

In one embodiment, the pasteurized bacterium of the invention and/or a variant thereof was not heated for a short time. In a particular embodiment, the pasteurized bacterium of the invention and/or a variant thereof was not heated for less than about 30 seconds, less than about 60 seconds, less than about 90 seconds or less than about 120 seconds. In a preferred embodiment, the pasteurized bacterium of the invention and/or a variant thereof was not heated for a time of less than about 1 minute, preferably for a time of less than about 5, 6, 7, 8, or 9 minutes.

In one embodiment, the pasteurized bacterium of the invention and/or a variant thereof was heated at a temperature ranging from about 50° C. to about 100° C. for at least about 10 minutes. In a particular embodiment, the pasteurized bacterium of the invention and/or a variant thereof was heated to about 60° C. for about 20 or about 30 minutes. In another particular embodiment, the pasteurized bacterium of the invention and/or a variant thereof was heated to about 70° C. for about 20 or about 30 minutes. In another particular embodiment, the pasteurized bacterium of the invention and/or a variant thereof was heated to about 80° C. for about 20 or about 30 minutes. In another particular embodiment, the pasteurized bacterium of the invention and/or a variant thereof was heated to about 90° C. for about 20 or about 30 minutes.

In a particular embodiment, the pasteurized bacterium of the invention and/or a variant thereof was not heated at a temperature superior to about 110° C. for about 1 to about 120 seconds. In another particular embodiment, the pasteurized bacterium of the invention and/or a variant thereof was not heated at a temperature superior to about 100° C. for about 1 to about 120 seconds. In another particular embodiment, the pasteurized bacterium of the invention and/or a variant thereof was not heated at a temperature superior to about 90° C. for about 1 to about 120 seconds.

In one embodiment, the bacterium of the invention and/or a variant thereof is treated with an ultra high temperature (UHT) treatment.

As used herein, a "UHT" treatment refers to an Ultra-high temperature processing or an ultra-heat treatment (both abbreviated UHT) involving the at least partial sterilization of a composition by heating it for a short time, such as, for example, from about 1 to about 60 seconds, preferably from about 1 to about 30 seconds, more preferably from about 1 to about 10 seconds, at a temperature of at least about 135° C.

There are two main types of UHT systems: the direct and indirect systems. In the direct system, products are treated by steam injection or steam infusion, whereas in the indirect system, products are heat treated using plate heat exchanger, tubular heat exchanger or scraped surface heat exchanger. Combinations of UHT systems may be applied at any step or at multiple steps in the process of product preparation.

In one embodiment, the bacterium of the invention and/or a variant thereof is flash pasteurized. Accordingly, in one embodiment, the bacterium of the invention and/or a variant thereof is treated at a temperature ranging from about 71.5° C. to about 74° C. for a period of time ranging from about 15 to about 30 seconds.

In another embodiment, the bacterium of the invention and/or a variant thereof is a not fresh. In one embodiment, the bacterium of the invention and/or a variant thereof is frozen.

As used herein the term 'frozen', refers to a bacterium that is cooled down at or below a temperature allowing a phase transition from liquid to solid in said bacterium. In one embodiment said temperature is about −5°, −20° C., −70° C., −80° C. or −190° C.

In one embodiment, cells recovered from the frozen bacterium of the invention and/or a variant thereof are viable. In other words, in one embodiment, the bacterium of the invention and/or a variant thereof is frozen and viable.

In one embodiment, at least about 50% of the cells recovered from the frozen bacterium of the invention are viable, preferably at least 60%, 65%, 70%, 75%, 80%, 85% of the cells recovered from the frozen bacterium of the invention are viable, more preferably at least 86%, 87%, 88%, 89%, 90%, 91%, 92%, 93%, 94% or 95% or more of the cells recovered from the frozen bacterium of the invention are viable.

Methods to prepare frozen stocks of bacteria from which viable cells can be recovered are known to the person of the art. Briefly and without limitation, bacteria may grow in a suitable liquid culture medium to reach the desired cell density. The desired volume of bacteria preparation may be diluted with a sterile glycerol solution for a final glycerol concentration comprised between 15% v/v to 50% v/v glycerol and transferred to a container able to sustain cold temperatures such as a cryogenic vial. The container may be then cooled down to temperature at or below −70° C.

In one embodiment, cells recovered from the frozen bacterium of the invention and/or a variant thereof are non-viable. In other words, in one embodiment, the bacterium of the invention and/or a variant thereof is frozen and non-viable.

In one embodiment, less than about 50% of the cells recovered from the frozen bacterium of the invention are viable, preferably less than about 40%, 35%, 30%, 25%, 20%, 15%, of the cells recovered from the frozen bacterium of the invention are viable, more preferably less than about 14%, 13%, 12%, 11%, 10%, 9%, 8%, 7%, 6%, 5% or less of the cells recovered from the frozen bacterium of the invention are viable. In one embodiment, about 7% of the cells recovered from the frozen bacterium of the invention are viable.

In one embodiment, the bacterium of the invention and/or a variant thereof is a not able to proliferate. In one embodiment, the bacterium of the invention and/or a variant thereof is dead. In one embodiment, the bacterium of the invention and/or a variant thereof is a not metabolically active or is metabolically inactive.

In one embodiment the bacterium of the invention is heat-inactivated. In one embodiment, the bacterium of the invention is heat-killed.

In a particular embodiment wherein the bacteria of the invention and/or a variant thereof is dead or non-viable, said bacterium and/or variant thereof was killed by heating. In one embodiment, the heat-inactivated or heat-killed bacterium of the invention and/or a variant thereof was heated at a temperature of at least about 90° C., preferably at least about 100° C., 105° C., 110° C., 115° C. or 120° C., more preferably at least about 121° C., 125° C., 130° C., 135° C., 140° C. or more. In one embodiment, the heat-inactivated or heat-killed bacterium of the invention and/or a variant thereof was heated at a temperature of about 90° C., preferably of about 100° C., 105° C., 110° C., 115° C. or 120° C., more preferably of about 121° C., 125° C., 130° C., 135° C. or 140° C.

In one embodiment, the heat-inactivated or heat-killed bacterium of the invention and/or a variant thereof was heated using a saturating steam pressure of at least about 10 psig, preferably at least about 11, 12, 13, 14, 15 or more psig. In one embodiment, the dead or non-viable bacterium of the invention and/or a variant thereof was heated using a saturating steam pressure of about 10 psig, preferably of about 11, 12, 13, 14 or 15 psig.

In one embodiment, the heat-inactivated or heat-killed bacterium of the invention and/or a variant thereof was heated for at least about 5 minutes, preferably for at least about 10 minutes, 15 minutes, 20 minutes, 25 minutes, 30 minutes or more. In one embodiment, the heat-inactivated or heat-killed bacterium of the invention and/or a variant thereof was heated for about 5 minutes, preferably for about 10 minutes, 15 minutes, 20 minutes, 25 minutes or 30 minutes.

The present invention further relates to fragments of the bacterium of the invention and/or a variant thereof.

As used herein, the term "fragment" refers to cellular components, metabolites, secreted molecules or vesicles and compounds resulting from the metabolism of the bacterium of the invention and/or a variant thereof and the like. Examples of cellular components include, but are not limited to, bacterial cell wall components such as peptidoglycan, bacterial nucleic acids such as DNA and RNA, bacterial membrane components, and bacterial structural components such as proteins, carbohydrates, lipids and combinations of these such as lipoproteins, glycolipids and glycoproteins, bacterial metabolites, organic acids, inorganic acids, bases, peptides, enzymes and co-enzymes, amino acids, carbohydrates, lipids, glycoproteins, lipoproteins, glycolipids, vitamins, bioactive compounds and metabolites containing an inorganic component. Fragments may be obtained by recovering the supernatant of a culture of the bacterium of the invention or by extracting cell components or cell fractions, metabolites or secreted compounds from a culture of the bacterium of the invention and/or a variant thereof, a degradation product, a component in the isolated form, any mixture of one or more components derived from the bacterium of the invention and/or a variant thereof, or one or more components present in the bacterium of the invention and/or a variant thereof that are produced in another way, such as, for example, using recombinant DNA technology, in a microbial host or in any other (bio)synthetic process.

The present invention further relates to a bacterial population comprising bacteria belonging to the genus *Dysosmobacter*, or to the species *Dysosmobacter welbionis*, as described herein. The present invention thus relates to a bacterial population comprising at least one bacterium of the invention and/or a variant thereof.

In one embodiment, the bacterial population of the invention is substantially pure, i.e., at least about 50% of the bacterial cells of the bacterial population are bacterial cells of the invention and/or variants thereof, preferably at least about 60%, 70%, 75%, 80%, 85%, 90%, 91%, 92%, 93%, 94%, 95%, 96%, 97%, 98%, 99% or more of the bacterial cells of the bacterial population are bacterial cells of the invention and/or variants thereof.

In one embodiment, the bacterium of the invention and/or a variant thereof is isolated.

As used herein, the term isolated refers to the separation of a bacterial cell from a natural, mixed population of living microbes, as present in the environment, for example in gut microbiota, water, soil, or skin. Isolated bacteria can be amplified on defined laboratory medium.

The present invention further relates to a method for isolating a bacterium of the invention and/or a variant thereof as described herein.

A non-limiting example of a method for isolating the bacteria of the invention and/or a variant thereof is provided in the experimental part.

In one embodiment, a feces sample is obtained from a subject and transferred into an anaerobic chamber (Coy) (containing, for example, 100% $N_2$ or 80% $N_2$, 15% $CO_2$, 5% $H_2$ as gas atmosphere) and immediately diluted (e.g., at a dilution 1/10) in an adapted medium. A non-limiting example of adapted medium is modified YCFA (Yeast extract—casein hydrolysate—fatty acids), that may optionally be enriched in antioxidants.

Fecal suspension may then be transferred in tubes hermetically sealed, such as, for example, under an atmosphere of about 20% $CO_2$-about 80% $N_2$, or 100% $CO_2$.

Then, single-cell cultivation may be performed using extinction dilution technique, such that a single vial received on average one cell.

In one embodiment, positive cultures after a period of time ranging from about 24 h to about 7 days are spread onto solid plates containing an adapted cell culture medium (such as, for example, the modified YCFA medium as described herein) and incubated for a period of time ranging from about 72 h to about 7 days in anaerobic jars with an $O_2$-absorbing and $CO_2$-generating agent. Single colonies may then be picked and transferred to fresh medium and the process is repeated until the cultures are deemed pure. The purify of the culture may be evaluated using methods well-known by the skilled artisan, such as, for example, observation of plated bacteria, microscopic observation, that may be combined with Fluorescent in situ hybridization (FISH) cytometry, PCR and/or by sequencing the 16s rRNA gene, in particular using multiplexed next-generation sequencing (NGS) techniques that allows the identification and the determination of the relative proportion of different bacterial species in a sample.

In one embodiment, the bacterium of the invention and/or a variant thereof is detectable by a nucleic acid amplification reaction using specifics primers.

In one embodiment, the bacterium of the invention and/or a variant thereof is detectable by a nucleic acid amplification reaction using at least one primer selected from the group comprising, or consisting of, SEQ ID NO: 17 and SEQ ID NO: 18.

In one embodiment, the bacterium of the invention and/or a variant thereof is detectable by a nucleic acid amplification reaction using primers of sequence SEQ ID NO: 17 and SEQ ID NO: 18.

The present invention further relates to a method for cultivating an isolated bacterium as described herein. In one embodiment, said method comprises culturing the bacterial cells in an adapted medium in an anaerobic atmosphere (e.g., in anaerobic jars with an $O_2$-absorbing and $CO_2$-generating agent) at a temperature of about 37° C.

A non-limiting example of composition of a defined laboratory medium that can be used to grow the bacteria of the invention is provided in tables 1 and 2 hereinafter.

In one embodiment, the culture of the bacteria of the invention is performed as described in the example hereinafter. Briefly, and without limitation, the bacteria of the invention may be cultured in suspension under a 20% $CO_2$-80% $N_2$ or 100% $CO_2$ atmosphere, in modified YCFA (Yeast extract—casein hydrolysate—fatty acids) medium as defined in tables 1 and 2, at 37° C. for 48 hours.

In one embodiment, the modified YCFA medium comprises soy peptone in an amount ranging from more than 0 g/L to about 20 g/L, preferably from about 2 g/L to about 6 g/L, more preferably in an amount of about 4 g/L.

In one embodiment, the modified YCFA medium comprises wheat peptone in an amount ranging from more than 0 g/L to about 20 g/L, preferably from about 2 g/L to about 6 g/L, more preferably in an amount of about 4 g/L.

In one embodiment, the modified YCFA medium comprises $Na_2CO_3$ in an amount ranging from more than 0 g/L to about 20 g/L, preferably from about 2 g/L to about 6 g/L, more preferably in an amount of about 4 g/L.

In one embodiment, the modified YCFA medium comprises $MgCl_2$ in an amount ranging from more than 0 mg/L to about 500 mg/L, preferably from about 25 mg/L to about 75 mg/L, more preferably in an amount of about 50 mg/L.

In one embodiment, the modified YCFA medium comprises glutathione in an amount ranging from more than 0 g/L to about 5 g/L, preferably from about 0.5 g/L to about 1.5 g/L, more preferably in an amount of about 1 g/L.

In one embodiment, the modified YCFA medium comprises ascorbate in an amount ranging from more than 0 g/L to about 1 g/L, preferably from about 0.25 g/L to about 0.75 g/L, more preferably in an amount of about 0.5 g/L.

In one embodiment, the modified YCFA medium comprises uric acid in an amount ranging from more than 0 g/L to about 1.2 g/L, preferably from about 0.2 g/L to about 0.4 g/L, more preferably in an amount of about 0.3 g/L.

In one embodiment, the modified YCFA medium comprises soy peptone in an amount of about 4 g/L, wheat peptone in an amount of about 4 g/L, $Na_2CO_3$ in an amount of about 50 mg/L, glutathione in an amount of about 1 g/L, ascorbate in an amount of about 1 g/L, ascorbate in an amount of about 0.5 g/L and uric acid in an amount of about 0.3 g/L.

In one embodiment, the modified YCFA medium is as defined in Tables 1 and 2.

The present invention also relates to a composition comprising, consisting of, or consisting essentially of, at least one bacterium of the invention and/or a variant thereof and/or a fragment thereof.

As used herein, the term "consisting essentially of", with reference to a composition, means that the at least one bacterium of the invention or fragment thereof is the only one agent with a biologic activity within said composition.

In one embodiment, at least about 0.5% of bacterial cells in the composition of the invention are cells of the bacterium of the invention and/or a variant thereof and/or a fragment thereof, preferably at least about 5%. 10%, 15%, 20%, 25%, 30%, 35%, 40%, 45%, 50%, 60%, 70%, 75%, 80%, 85%, 90%, 95%, 96%, 97%, 98%, 99%, or more, of bacterial cells in the composition of the invention are cells of bacterium of the invention and/or a variant thereof and/or a fragment thereof.

In one embodiment of the invention, the composition of the invention comprises an amount of the bacterium of the invention and/or a variant thereof ranging from about $1 \cdot 10^2$ to about $1 \cdot 10^{15}$ cfu/g of the composition, preferably from about $1 \cdot 10^4$ to about $1 \cdot 10^{12}$ cfu/g of the composition, more preferably from about $1 \cdot 10^5$ to about $1 \cdot 10^{10}$ cfu/g of the composition and even more preferably from about $1 \cdot 10^6$ to about $5 \cdot 10^9$ cfu/g of the composition. In one embodiment, the composition of the invention comprises an amount of the bacterium of the invention and/or a variant thereof ranging from about $1 \cdot 10^4$ to about $1 \cdot 10^{14}$ cfu/g of the composition, preferably from about $1 \cdot 10^5$ to about $1 \cdot 10^{13}$ cfu/g of the composition, more preferably from about $1 \cdot 10^6$ to about $1 \cdot 10^{12}$ cfu/g of the composition, even more preferably from about $1 \cdot 10^7$ to about $1 \cdot 10^{11}$ cfu/g of the composition, from about $1 \cdot 10^8$ to about $1 \cdot 10^{10}$ cfu/g of the composition, and even more preferably from about $2 \cdot 10^8$ to about $6 \cdot 10^9$ cfu/g of the composition.

As used herein, "cfu" stands for "colony forming unit".

In one embodiment of the invention, the composition of the invention comprises an amount of the bacterium of the invention and/or a variant thereof ranging from about $1 \cdot 10^2$ to about $1 \cdot 10^{15}$ cfu/mL of the composition, preferably from about $1 \cdot 10^4$ to about $1 \cdot 10^{12}$ cfu/mL of the composition, more preferably from about $1 \cdot 10^5$ to about $1 \cdot 10^{10}$ cfu/mL of the composition and even more preferably from about $1 \cdot 10^6$ to about $5 \cdot 10^9$ cfu/mL of the composition. In one embodiment, the composition of the invention comprises an amount of the bacterium of the invention and/or a variant thereof ranging from about $1 \cdot 10^4$ to about $1 \cdot 10^{14}$ cfu/mL of the composition, preferably from about $1 \cdot 10^5$ to about $1 \cdot 10^{13}$ cfu/mL of the composition, more preferably from about $1 \cdot 10^6$ to about $1 \cdot 10^{12}$ cfu/mL of the composition, even more preferably from about $1 \cdot 10^7$ to about $1 \cdot 10^{11}$ cfu/mL of the composition, $1 \cdot 10^8$ to about $1 \cdot 10^{10}$ cfu/mL of the composition, and even more preferably from about $2 \cdot 10^8$ to about $6 \cdot 10^9$ cfu/mL of the composition.

In one embodiment of the invention, the composition of the invention comprises an amount of the bacterium of the invention ranging from about $1\cdot10^6$ to about $1\cdot10^{10}$ cfu/g or cfu/mL of the composition, preferably from about $1\cdot10^8$ to about $1\cdot10^{10}$ cfu/g or cfu/mL, more preferably from about $1\cdot10^9$ to about $1\cdot10^{10}$ cfu/g or cfu/mL. In one embodiment of the invention, the composition of the invention comprises an amount of the bacterium of the invention ranging from about $1\cdot10^6$ to about $1\cdot10^{11}$ cfu/g or cfu/mL of the composition, preferably from about $1\cdot10^8$ to about $1\cdot10^{11}$ cfu/g or cfu/mL, more preferably from about $1\cdot10^{10}$ to about $1\cdot10^{11}$ cfu/g or cfu/mL.

In one embodiment of the invention, the composition of the invention comprises an amount of the bacterium of the invention and/or a variant thereof ranging from about $1\cdot10^2$ to about $1\cdot10^{15}$ cells/g of the composition, preferably from about $1\cdot10^4$ to about $1\cdot10^{12}$ cells/g of the composition, more preferably from about $1\cdot10^5$ to about $1\cdot10^{10}$ cells/g of the composition and even more preferably from about $1\cdot10^6$ to about $1\cdot10^9$ cells/g of the composition. In one embodiment, the composition of the invention comprises an amount of the bacterium of the invention and/or a variant thereof ranging from about $1\cdot10^4$ to about $1\cdot10^{14}$ cells/g of the composition, preferably from about $1\cdot10^5$ to about $1\cdot10^{13}$ cells/g of the composition, more preferably from about $1\cdot10^6$ to about $1\cdot10^{12}$ cells/g of the composition, even more preferably from about $1\cdot10^7$ to about $1\cdot10^{11}$ cells/g of the composition, from about $1\cdot10^8$ to about $1\cdot10^{10}$ cells/g of the composition, and even more preferably from about $1\cdot10^9$ to about $1\cdot10^{10}$ cells/g of the composition.

In one embodiment of the invention, the composition of the invention comprises an amount of the bacterium of the invention and/or a variant thereof ranging from about $1\cdot10^2$ to about $1\cdot10^{15}$ cells/mL of the composition, preferably from about $1\cdot10^4$ to about $1\cdot10^{12}$ cells/mL of the composition, more preferably from about $1\cdot10^5$ to about $1\cdot10^{10}$ cells/mL of the composition and even more preferably from about $1\cdot10^6$ to about $1\cdot10^9$ cells/mL of the composition. In one embodiment, the composition of the invention comprises an amount of the bacterium of the invention and/or a variant thereof ranging from about $1\cdot10^4$ to about $1\cdot10^{14}$ cells/mL of the composition, preferably from about $1\cdot10^5$ to about $1\cdot10^{13}$ cells/mL of the composition, more preferably from about $1\cdot10^6$ to about $1\cdot10^{12}$ cells/mL of the composition, even more preferably from about $1\cdot10^7$ to about $1\cdot10^{11}$ cells/mL of the composition, from about $1\cdot10^8$ to about $1\cdot10^{10}$ cells/mL of the composition, and even more preferably from about $1\cdot10^9$ to about $1\cdot10^{10}$ cells/mL of the composition.

In one embodiment of the invention, the composition of the invention comprises an amount of the bacterium of the invention ranging from about $1\cdot10^6$ to about $1\cdot10^{10}$ cells/g or cells/mL of the composition, preferably from about $1\cdot10^8$ to about $1\cdot10^{10}$ cells/g or cells/mL, more preferably from about $1\cdot10^9$ to about $1\cdot10^{10}$ cells/g or cells/mL. In one embodiment of the invention, the composition of the invention comprises an amount of the bacterium of the invention ranging from about $1\cdot10^6$ to about $1\cdot10^{11}$ cells/g or cells/mL of the composition, preferably from about $1\cdot10^8$ to about $1\cdot10^{11}$ cells/g or cells/mL, more preferably from about $1\cdot10^{10}$ to about $1\cdot10^{11}$ cells/g or cells/mL.

In one embodiment of the invention, the composition of the invention comprises an amount of fragment of the bacterium of the invention and/or a variant thereof corresponding to an amount of bacterium of the invention and/or a variant thereof ranging from about $1\cdot10^2$ to about $1\cdot10^{15}$ cfu/g of the composition, preferably from about $1\cdot10^4$ to about $1\cdot10^{12}$ cfu/g of the composition, more preferably from about $1\cdot10^5$ to about $1\cdot10^{10}$ cfu/g of the composition and even more preferably from about $1\cdot10^6$ to about $1\cdot10^9$ cfu/g of the composition. In one embodiment, the composition of the invention comprises an amount of fragment of the bacterium of the invention and/or a variant thereof corresponding to an amount of bacterium of the invention and/or a variant thereof ranging from about $1\cdot10^4$ to about $1\cdot10^{14}$ cfu/g of the composition, preferably from about $1\cdot10^5$ to about $1\cdot10^{13}$ cfu/g of the composition, more preferably from about $1\cdot10^6$ to about $1\cdot10^{12}$ cfu/g of the composition, even more preferably from about $1\cdot10^7$ to about $1\cdot10^{11}$ cfu/g of the composition, from about $1\cdot10^8$ to about $1\cdot10^{10}$ cfu/g of the composition, and even more preferably from about $2.10^8$ to about $6.10^9$ cfu/g of the composition.

In one embodiment of the invention, the composition of the invention comprises an amount of fragment of the bacterium of the invention and/or a variant thereof corresponding to an amount of bacterium of the invention and/or a variant thereof ranging from about $1\cdot10^2$ to about $1\cdot10^{15}$ cfu/mL of the composition, preferably from about $1\cdot10^4$ to about $1\cdot10^{12}$ cfu/mL of the composition, more preferably from about $1\cdot10^5$ to about $1\cdot10^{10}$ cfu/mL of the composition and even more preferably from about $1\cdot10^6$ to about $1\cdot10^9$ cfu/mL of the composition. In one embodiment of the invention, the composition of the invention comprises an amount of fragment of the bacterium of the invention and/or a variant thereof corresponding to an amount of bacterium of the invention and/or a variant thereof ranging from about $1\cdot10^4$ to about $1\cdot10^{14}$ cfu/mL of the composition, preferably from about $1\cdot10^5$ to about $1\cdot10^{13}$ cfu/mL of the composition, more preferably from about $1\cdot10^6$ to about $1\cdot10^{12}$ cfu/mL of the composition, even more preferably from about $1\cdot10^7$ to about $1\cdot10^{11}$ cfu/mL of the composition. In one embodiment of the invention, the composition of the invention comprises an amount of fragment of the bacterium of the invention and/or a variant thereof corresponding to an amount of bacterium of the invention and/or a variant thereof ranging from about $1\cdot10^8$ to about $1\cdot10^{10}$ cfu/mL of the composition, preferably from about $2.10^8$ to about $6.10^9$ cfu/mL of the composition.

In one embodiment of the invention, the composition of the invention comprises an amount of fragment of the bacterium of the invention and/or a variant thereof corresponding to an amount of bacterium of the invention and/or a variant thereof ranging from about $1\cdot10^6$ to about $1\cdot10^{10}$ cfu/g or cfu/mL of the composition, preferably from about $1\cdot10^8$ to about $1\cdot10^{10}$ cfu/g or cfu/mL, more preferably from about $1\cdot10^9$ to about $1\cdot10^{10}$ cfu/g or cfu/mL.

In one embodiment of the invention, the composition of the invention comprises an amount of fragment of the bacterium of the invention corresponding to an amount of bacterium of the invention ranging from about $1\cdot10^6$ to about $1\cdot10^{11}$ cfu/g or cfu/mL of the composition, preferably from about $1\cdot10^8$ to about $1\cdot10^{11}$ cfu/g or cfu/mL, more preferably from about $1\cdot10^{10}$ to about $1\cdot10^{11}$ cfu/g or cfu/mL.

In one embodiment of the invention, the composition of the invention comprises an amount of fragment of the bacterium of the invention and/or a variant thereof corresponding to an amount of bacterium of the invention and/or a variant thereof ranging from about $1\cdot10^2$ to about $1\cdot10^{15}$ cells/g of the composition, preferably from about $1\cdot10^4$ to about $1\cdot10^{12}$ cells/g of the composition, more preferably from about $1\cdot10^5$ to about $1\cdot10^{10}$ cells/g of the composition and even more preferably from about $1\cdot10^6$ to about $1\cdot10^9$ cells/g of the composition. In one embodiment of the invention, the composition of the invention comprises an amount of fragment of the bacterium of the invention and/or a variant thereof corresponding to an amount of bacterium of the invention and/or a variant thereof ranging from about $1\cdot10^4$ to about $1\cdot10^{14}$ cells/g of the composition, preferably from about $1\cdot10^5$ to about $1\cdot10^{13}$ cells/g of the composition, more preferably from about $1\cdot10^6$ to about $1\cdot10^{12}$ cells/g of the composition, even more preferably from about $1\cdot10^7$ to about $1\cdot10^{11}$ cells/g of the composition. In one embodiment of the invention, the composition of the invention comprises an amount of fragment of the bacterium of the invention and/or a variant thereof corresponding to an amount of bacterium of the invention and/or a variant thereof ranging from about $1\cdot10^8$ to about $1\cdot10^{10}$ cells/g of the composition, preferably from about $1\cdot10^9$ to about $1\cdot10^{10}$ cells/g of the composition.

In one embodiment of the invention, the composition of the invention comprises an amount of fragment of the bacterium of the invention and/or a variant thereof corresponding to an amount of bacterium of the invention and/or a variant thereof ranging from about $1\cdot10^2$ to about $1\cdot10^{15}$ cells/mL of the composition, preferably from about $1\cdot10^4$ to about $1\cdot10^{12}$ cells/mL of the composition, more preferably from about $1\cdot10^5$ to about $1\cdot10^{10}$ cells/mL of the composition and even more preferably from about $1\cdot10^6$ to about $1\cdot10^9$ cells/mL of the composition. In one embodiment of the invention, the composition of the invention comprises an amount of fragment of the bacterium of the invention and/or a variant thereof corresponding to an amount of bacterium of the invention and/or a variant thereof ranging from about $1\cdot10^4$ to about $1\cdot10^{14}$ cells/mL of the composition, preferably from about $1\cdot10^5$ to about $1\cdot10^{13}$ cells/mL of the composition, more preferably from about $1\cdot10^6$ to about $1\cdot10^{12}$ cells/mL of the composition, even more preferably from about $1\cdot10^7$ to about $1\cdot10^{11}$ cells/mL of the composition. In one embodiment of the invention, the composition of the invention comprises an amount of fragment of the bacterium of the invention and/or a variant thereof corresponding to an amount of bacterium of the invention and/or a variant thereof ranging from about $1\cdot10^8$ to about $1\cdot10^{10}$ cells/mL of the composition, preferably from about $1\cdot10^9$ to about $1\cdot10^{10}$ cells/mL of the composition.

In one embodiment of the invention, the composition of the invention comprises an amount of fragment of the bacterium of the invention corresponding to an amount of bacterium of the invention ranging from about $1\cdot10^6$ to about $1\cdot10^{10}$ cells/g or cells/mL of the composition, preferably from about $1\cdot10^8$ to about $1\cdot10^{10}$ cells/g or cells/mL, more preferably from about $1\cdot10^9$ to about $1\cdot10^{10}$ cells/g or cells/mL.

In one embodiment of the invention, the composition of the invention comprises an amount of fragment of the bacterium of the invention corresponding to an amount of bacterium of the invention ranging from about $1\cdot10^6$ to about $1\cdot10^{11}$ cells/g or cells/mL of the composition, preferably from about $1\cdot10^8$ to about $1\cdot10^{11}$ cells/g or cells/mL, more preferably from about $1\cdot10^{10}$ to about $1\cdot10^{11}$ cells/g or cells/mL.

In one embodiment, the bacterium of the invention and/or a variant thereof is pasteurized, and the amounts recited herein corresponds to amounts before the step of pasteurization.

In one embodiment, the bacterium of the invention and/or a variant thereof is frozen, and the amounts recited herein corresponds to amounts before the freezing step. In another embodiment, the bacterium of the invention and/or a variant thereof is frozen, and the amounts recited herein corresponds to amounts after the freezing step.

The present invention also relates to at least one bacterium and/or variant thereof as described herein above as a probiotic. In one embodiment, the at least one bacterium of the invention, preferably the strain J115, and/or variant thereof is probiotics, which is beneficial for improving the gastrointestinal environment of a subject.

The present invention further relates to the therapeutic use of at least one bacterium of the invention and/or a variant thereof and/or a fragment thereof.

In one embodiment, the composition of the invention is a pharmaceutical composition or a medicament.

The present invention thus also relates to a pharmaceutical composition comprising, consisting essentially of or consisting of the bacterium or the composition according to the invention and at least one pharmaceutically acceptable excipient.

Pharmaceutically acceptable excipients that may be used in the compositions of the invention include, but are not limited to, ion exchangers, alumina, aluminum stearate, lecithin, serum proteins, such as human serum albumin, trehalose, buffer substances such as phosphates, glycine, sorbic acid, potassium sorbate, partial glyceride mixtures of saturated vegetable fatty acids, water, salts or electrolytes, such as protamine sulfate, disodium hydrogen phosphate, potassium hydrogen phosphate, sodium chloride, zinc salts, silica, colloidal silica, magnesium trisilicate, polyvinyl pyrolidone, cellulose-based substances (for example sodium carboxymethylcellulose), polyethylene glycol, polyacrylates, waxes, polyethylene-polyoxypropylene-block polymers, polyethylene glycol and wool fat.

In one embodiment, the pharmaceutical composition is for treating and/or preventing a disease related to the gut microbiota, preferably a metabolic disease.

The present invention further relates to a medicament comprising, consisting essentially of or consisting of the bacterium or the composition according to the invention. The invention also relates to the use of a bacterium or composition according to the invention for the manufacture of a medicament.

In one embodiment, the medicament is for treating and/or preventing a disease related to the gut microbiota, preferably a metabolic disease.

In one embodiment, the pharmaceutical composition or medicament of the invention may further contain antioxidant agents such as ascorbic acid, ascorbyl palmitate, BHT, potassium sorbate or *Rosmarinus officinalis* extracts.

In one embodiment, the pharmaceutical composition or medicament of the invention may further contain flavour agents such as sugars, fruit or tea flavourings.

In one embodiment, composition comprising at least one bacterium of the invention and/or fragments thereof can be prepared in water suitably mixed with a surfactant, such as hydroxypropylcellulose.

In one embodiment, composition comprising at least one bacterium of the invention and/or fragments thereof can also be prepared in glycerol, liquid polyethylene glycols, and mixtures thereof and in oils.

In one embodiment, the composition comprising at least one bacterium of the invention and/or fragments thereof may comprise a carrier that can also be a solvent or dispersion medium containing, for example, water, ethanol, polyol (for example, glycerol, propylene glycol, and liquid polyethylene glycol, and the like), suitable mixtures thereof, and vegetables oils such as oleic acid.

The proper fluidity can be maintained, for example, by the use of a coating, such as lecithin (i.e., Soy lecithin or de-greased soy lecithin), by the maintenance of the required particle size in the case of dispersion and by the use of surfactants.

In many cases, it will be preferable to include isotonic agents, for example, sugars or sodium chloride. Generally, dispersions are prepared by incorporating the various sterilized active ingredients into a sterile vehicle which contains the basic dispersion medium and the required other ingredients from those enumerated above.

Upon formulation, the pharmaceutical composition or the medicament of the invention will be administered in a manner compatible with the dosage formulation and in such amount as is effective. The pharmaceutical composition or the medicament of the invention may be administered in a variety of dosage forms, such as drug release capsules and the like. Some variation in dosage will necessarily occur depending on the condition of the subject being treated. The person responsible for administration will, in any event, determine the appropriate dose for the individual subject.

The pharmaceutical composition and medicament of the present invention, the bacterium of the invention and/or a variant thereof, and/or fragment thereof, alone or in combination with another active principle, can be administered in a unit administration form, as a mixture with conventional pharmaceutical supports, to animals and human beings. Suitable unit administration forms comprise oral-route forms such as tablets, gel capsules, powders, granules and oral suspensions or solutions, sublingual and buccal administration forms, aerosols, implants, subcutaneous, transdermal, topical, intraperitoneal, intramuscular, intravenous, subdermal, transdermal, intrathecal and intranasal administration forms and rectal administration forms.

In one embodiment, the bacterium of the invention and/or a variant thereof and/or fragments thereof, the composition, the pharmaceutical composition or the medicament of the invention is to be administered, or is adapted to be administered, systemically or locally.

In one embodiment, the bacterium of the invention and/or a variant thereof and/or fragments thereof, the composition, pharmaceutical composition or medicament of the invention is to be administered, or is adapted to be administered, orally, buccally, by injection, by percutaneous administration, parenterally, intraperitoneal, by endoscopy, topically, transdermally, transmucosally, nasally, by inhalation spray, rectally, vaginally, intratracheally, and via an implanted reservoir, or any combination thereof.

In one embodiment, the bacterium of the invention and/or a variant thereof and/or fragments thereof, the composition, pharmaceutical composition or medicament of the invention is to be orally administered, or is adapted to be orally administered. Examples of formulations adapted to oral administration include, but are not limited to, solid forms, liquid forms and gels. Examples of solid forms adapted to oral administration include, but are not limited to, pill, tablet, capsule, soft gelatine capsule, hard gelatine capsule, dragees, granules, caplet, compressed tablet, cachet, wafer, sugar-coated pill, sugar coated tablet, or dispersing/or disintegrating tablet, powder, solid forms suitable for solution in, or suspension in, liquid prior to oral administration and effervescent tablet. Examples of liquid form adapted to oral administration include, but are not limited to, solutions, suspensions, drinkable solutions, elixirs, sealed phial, portion, drench, syrup, liquor and sprays.

In one embodiment, the bacterium of the invention and/or a variant thereof and/or fragments thereof, the composition, pharmaceutical composition or medicament of the invention is to be administered rectally, or is adapted to be rectally administered. Example of formulations adapted to rectal administration include, but are not limited to: suppository, micro enemas, enemas, gel, rectal foam, cream, ointment.

In one embodiment, the bacterium of the invention and/or a variant thereof and/or fragments thereof, the composition, pharmaceutical composition or medicament of the invention is to be injected, or is adapted to be injected. Examples of formulations adapted to injections include, but are not limited to, liquid solutions or suspensions, solid forms suitable for solution in, or suspension in, liquid prior to injection.

Examples of systemic injections include, but are not limited to, intravenous, intratumoral, intracranial, intralymphatic, intraperitoneal, intramuscular, subcutaneous, intradermal, intraarticular, intrasynovial, intrasternal, intrathecal, intravesical, intrahepatic, intralesional, intracavernous, infusion techniques and perfusion. In another embodiment, when injected, the composition, the pharmaceutical composition or the medicament of the invention is sterile.

Methods for obtaining a sterile pharmaceutical composition include, but are not limited to, GMP synthesis (GMP stands for "Good manufacturing practice").

In one embodiment, the bacterium of the invention and/or a variant thereof and/or fragments thereof, the composition, pharmaceutical composition or medicament of the invention is to be administered, or is adapted to be administered, in an immediate release form. In one embodiment, the bacterium of the invention and/or a variant thereof and/or fragments thereof, the composition, pharmaceutical composition or medicament of the invention is to be administered, or is adapted to be administered, in a mixed-release form. In one embodiment, the bacterium of the invention and/or a variant thereof and/or fragments thereof, the composition, pharmaceutical composition or medicament of the invention is to be administered, or is adapted to be administered, in an enterically-coated form. In one embodiment, the bacterium of the invention and/or a variant thereof and/or fragments thereof, the composition, pharmaceutical composition or medicament of the invention is to be administered, or is adapted to be administered, in a sustained-release form.

In one embodiment, the bacterium of the invention and/or a variant thereof and/or fragments thereof, the composition, pharmaceutical composition or medicament of the invention comprises a delivery system that controls the release of the active ingredients.

In one embodiment, the composition, the pharmaceutical composition or the medicament of the invention further comprises at least one additional probiotic strain or species, such as, for example, bacterial probiotic strains or species; prokaryotes probiotics other than bacteria; or fungal strains or species, preferably yeast strains or species. In one embodiment, said additional probiotic strains or species are selected from those naturally present in the gut of the subject, preferably in the human gut, more preferably in the gut of substantially healthy human subjects. In one embodiment, said additional probiotic strains or species are selected for strains or species not according naturally in the gut of the subject such as those found for instance in dairy products.

In one embodiment, the composition, the pharmaceutical composition or the medicament of the invention further comprises at least one bacterial probiotic strain or species selected from the group comprising or consisting of *Lactobacillus, Lactococcus, Akkerinansia, Bifidobacterium, Veillonella, Desemzia, Christensenella, Allobaculum, Coprococcus, Collinsella, Citrobacter, Turicibacter, Sutterella, Subdoligranulum, Streptococcus, Sporobacter, Sporacetigenium, Ruminococcus, Roseburia, Proteus, Propionibacterium, Leuconostoc, Weissella, Pediococcus, Streptococcus, Prevotella, Parabacteroides, Papillibacter, Oscillospira, Melissococcus, Dorea, Dialister, Clostridium, Cedecea,*

*Catenibacterium, Butyrivibrio, Buttiauxella, Bulleidia, Bilophila, Bacteroides, Anaerovorax,* Anaerostopes, *Anaerofilum,* Enterobacteriaceae, Fermicutes, *Atopobium, Alistipes, Acinetobacter, Slackie, Shigella, Shewanella, Serratia, Mahella, Lachnospira, Klebsiella, Idiomarina, Fusobacterium, Faecalibacterium, Eubacterium, Enterococcus, Enterobacter,* and *Eggerthella* or a mixture thereof.

In one embodiment, the composition, the pharmaceutical composition or the medicament of the invention further comprises at least one prokaryote strain or species selected from the group comprising or consisting of *archaea*, Firmicutes, Verrucomicrobia (such as, for example, *Akkermansia muciniphila*), *Christensenella*, Bacteroidetes (such as, for example, Allistipes, *Bacteroides ovatus, Bacteroides splachnicus, Bacteroides stercoris, Bacteroides vulgatus, Parabacteroides, Prevotella ruminicola,* Porphyromondaceae, and related genus), Proteobacteria, Betaproteobacteria (such as, for example, *Aquabacterium* and *Burkholderia*), Gammaproteobacteria (such as, for example, Xanthomonadaceae), Actinobacteria (such as, for example, Actinomycetaceae and *Atopobium*), Methanobacteria, Spirochaetes, Fibrobacteres, Deferribacteres, *Deinococcus, Thermus,* Cyanobacteria, Methanobrevibacteria, *Ruminococcus, Coprococcus,* Subdolingranulum, *Dorea, Bulleidia, Anaerofustis, Gemella, Roseburia, Dialister, Anaerotruncus, Staphylococcus, Micrococcus,* Propionibacteria, Enterobacteriaceae, *Faecalibacterium, Bacteroides, Parabacteroides, Prevotella, Eubacterium,* Bacilli (such as, for example, *Lactobacillus salivarius* and related species, *Aerococcus, Granulicatella, Streptococcus bovis* and related genus and *Streptococcus intermedius* and related genus), *Clostridium* (such as, for example, *Eubacterium hallii, Eubacterium* linwsum and related genus) and *Butyrivibrio* or a mixture thereof.

In one embodiment, the composition, the pharmaceutical composition or the medicament of the invention further comprises at least one fungal probiotic strain or species, preferably yeast probiotic strain or species, selected from the group comprising or consisting of Ascomycetes, Zygomycetes and Deuteromycetes, preferably from the groups *Aspergillus, Torulopsis, Zygosaccharomyces, Hansenula, Candida, Saccharomyces, Clavispora,* Bretanomyces, *Pichia, Amylomyces, Zygosaccharomyces,* Endomycess, *Hyphopichia, Zygosaccharomyces, Kluyveromyces, Mucor, Rhizopus, Yarrowia, Endomyces, Debaryomyces,* and *Penicillium* or a mixture thereof.

In one embodiment, the composition, the pharmaceutical composition or the medicament of the invention further comprises at least one prebiotic.

In one embodiment, the composition, the pharmaceutical composition or the medicament of the invention further comprises at least one prebiotic selected from the group comprising or consisting of myo-inositol, inulin and inulin-type fructans, oligofructose, beta-glucans, xylose, arabinose, arabinoxylan, ribose, galactose, rhamnose, cellobiose, fructose, lactose, salicin, sucrose, glucose, esculin, tween 80, trehalose, maltose, mannose, mellibiose, mucus or mucins, raffinose, fructooligosaccharides, galacto-oligosaccharides, amino acids, alcohols, fermentable carbohydrates and any combinations thereof.

In a particular embodiment, the composition, the pharmaceutical composition or the medicament of the invention further comprises myo-inositol.

Other non-limiting examples of prebiotics include water-soluble cellulose derivatives, water-insoluble cellulose derivatives, unprocessed oatmeal, metamucil, all-bran, polyphenols and any combinations thereof.

Examples of water-soluble cellulose derivatives include, but are not limited to, methylcellulose, methyl ethyl cellulose, hydroxyethyl cellulose, ethyl hydroxyethyl cellulose, cationic hydroxyethyl cellulose, hydroxypropyl cellulose, hydroxyethyl methylcellulose, hydroxypropyl methylcellulose, and carboxymethyl cellulose.

The present invention also relates to a therapeutic combination product for its separate, simultaneous or sequential administration.

As used herein the term "therapeutic combination product" (that may also be referred to as a therapeutic kit of parts) refers to a product comprising or consisting of at least the 2 following parts: a first part comprising (preferably in a therapeutically affective amount) a bacterium of the invention and/or a variant thereof, a composition according to the invention, a pharmaceutical composition according to the invention, or a medicament according to the invention and a second part comprising a composition comprising at least one probiotic and/or at least one prebiotic and/or one other drug for a therapeutic use. In one embodiment, the therapeutic combination product is for treating and/or preventing a disease related to the gut microbiota, preferably a metabolic disease.

Examples of other drugs known for their use in treating and/or preventing metabolic diseases include, but are not limited to, sulphonylurea (such as, for example, acetohexamide, carbutamide, chlorpropamide, glycyclamide, metahexamide, tolazamide, tolbutamide, glibenclamide, glibornuride, gliclazide, glipizide, gliquidone, glisoxepide, glyclopyramide and glimepiride and their derivatives); biguanides (such as, for example, metformin, pheformin and buformin); alpha-glucosidase inhibitors (such as, for example, acarbose, miglitol and voglibose); thiazolidinedione (such as, for example, pioglitazone, rosiglitazone and lobeglitazone); HMG-CoA reductase inhibitors (or statins) (such as, for example, simvastatin, pravastatin, atorvastatin, mevastatin, cerivastatin, rosuvastatin and fluvastatin); dipeptidyl peptidase 4 inhibitors (or gliptins) (such as, for example, sitagliptin, vildagliptin, sawagliptin, linagliptin, gemigliptin, anagliptin, teneligliptin, alogliptin, trelagliptin, omarigliptin, evogliptin, gosopliptin, dutogliptin and berberine); glucagon-like peptide analogs and agonists (such as, for example, exenatide, liraglutide and lixisenatide); sodium/glucose cotransporter 2 inhibitors (such as, for example, empagliflozin, dapagliflozin, canagliflozin, ipragliflozin, ertugliflozin, luseogliflozin, bexagliflozin, todogliflozin, henagliflozin, sotagliflozin, remogliflozin, sergliflozin and atigliflozin); cholestyramine, colesevelam, colestipol and ezetimibe.

In one embodiment, the at least two parts of the therapeutic combination product according to the invention are administered simultaneously. In another embodiment, the at least two parts of the therapeutic combination product according to the invention are administered at a different time. In another embodiment, at least two parts of the therapeutic combination product according to the invention are administered sequentially.

In one embodiment, the at least two parts of the therapeutic combination product according to the invention are administered using different administration routes (such as, for example, one part by oral administration, and the second one by injection). In another embodiment, the at least two parts of the therapeutic combination product according to the invention are administered using the same administration route (such as, for example, oral administration or injection).

In one embodiment, the bacterium of the invention and/or a variant thereof and/or fragments thereof, the composition, pharmaceutical composition, the therapeutic combination product of the invention is for use as a medicament.

The present invention further relates to at least one bacterium of the invention and/or a variant thereof and/or fragments thereof, or to the composition, pharmaceutical composition, medicament or therapeutic combination product of the invention for use in the treatment and/or prevention of disorders related to the gastrointestinal microbiota in a subject in need thereof.

Example of disorders related to the gastrointestinal microbiota include, but are not limited to, metabolic diseases (such as for example, obesity, metabolic syndrome, insulin-deficiency or insulin-resistance related disorders, Diabetes Mellitus (such as, for example, Type 2 Diabetes), glucose intolerance, hyperglycemia, abnormal lipid metabolism, dyslipidemia, high cholesterol, elevated LDL-cholesterol, decreased LDL cholesterol, elevated triglycerides, adipose tissues inflammation and adipose tissue fibrosis, infections, colitis (such as for example, inflammatory bowel disease (e.g., Crohn's disease and ulcerative colitis), ischemic colitis, irritable bowel syndrome, lymphocytic colitis and collagenous colitis), cancers (such as for example, colorectal cancer), dysfunction of the immune system (such as for example, eczema, allergies, food allergies and celiac disease), psychological disorders (such as for example, stress, anxiety and addiction), neurological disorders (such as for example, Parkinson's disease and Alzheimer's disease), liver diseases (such as for example, cirrhosis, non-alcoholic fatty liver disease, and hepatic steatosis), cachexia, Prader-Willy syndrome, dysfunction of the digestive tract (such as for example, ulcers and gallbladder disease), feeding behaviors disorders (such as for example, anorexia nervosa, bulimia nervosa and binge-eating disorder), cardiovascular diseases and conditions (such as, for example strokes, atherosclerosis and hypertension), asthma, sleep apnea, osteoarthritis and inflammatory diseases.

In one embodiment, at least one bacterium of the invention and/or a variant thereof and/or fragments thereof, the composition, the pharmaceutical composition, the medicament or the therapeutic combination product of the invention is for, or for use in, the treatment and/or prevention of diseases selected from the group comprising, or consisting of, metabolic diseases, obesity, metabolic syndrome, insulin-deficiency or insulin-resistance related disorders, Diabetes Mellitus, type 2 diabetes, type 1 diabetes, glucose intolerance, hyperglycemia, abnormal lipid metabolism, dyslipidemia, high cholesterol, elevated LDL-cholesterol, decreased LDL cholesterol, elevated triglycerides, adipose tissues inflammation, adipose tissue fibrosis, infections, colitis, inflammatory bowel disease, Crohn's disease, ulcerative colitis, ischemic colitis, irritable bowel syndrome, lymphocytic colitis, collagenous colitis, enteritis, cancers, colorectal cancer, dysfunction of the immune system, eczema, allergies, food allergies, celiac disease, psychological disorders, stress, anxiety, addiction, neurological disorders, Parkinson's disease, Alzheimer's disease, liver diseases, cirrhosis, non-alcoholic fatty liver disease, hepatic steatosis, cachexia, Prader-Willy syndrome, dysfunction of the digestive tract, ulcers, gallbladder disease, feeding behaviors disorders, anorexia nervosa, bulimia nervosa, binge-eating disorder, cardiovascular diseases, strokes, atherosclerosis and hypertension, asthma, sleep apnea, osteoarthritis and inflammatory diseases.

In one embodiment, at least one bacterium of the invention and/or a variant thereof and/or fragments thereof, the composition, the pharmaceutical composition, the medicament or the therapeutic combination product of the invention is for, or for use in, the treatment and/or prevention of diseases selected from the group comprising, or consisting of, metabolic diseases, obesity, metabolic syndrome, insulin-deficiency or insulin-resistance related disorders, Diabetes Mellitus, type 2 diabetes, type 1 diabetes, glucose intolerance, hyperglycemia, abnormal lipid metabolism, dyslipidemia, high cholesterol, elevated LDL-cholesterol, decreased LDL cholesterol, elevated triglycerides, adipose tissues inflammation, adipose tissue fibrosis, infections, colitis, inflammatory bowel disease, Crohn's disease, ulcerative colitis, ischemic colitis, irritable bowel syndrome, lymphocytic colitis, collagenous colitis, enteritis, food allergies, celiac disease, ulcers, cachexia, Prader-Willy syndrome, feeding behaviors disorders and binge-eating disorder.

In one embodiment, at least one bacterium of the invention and/or variant thereof and/or fragments thereof, the composition, the pharmaceutical composition, the medicament or the therapeutic combination product of the invention is for, or for use in, the treatment and/or prevention of diseases selected from the group comprising, or consisting of, metabolic diseases, infections, colitis, enteritis, food allergies, celiac disease, ulcers, cachexia, Prader-Willy syndrome and feeding behaviors disorders.

In one embodiment, the disorder related to the gastrointestinal microbiota is a metabolic disease.

Example of metabolic diseases include, but are not limited to obesity, metabolic syndrome, insulin-deficiency or insulin-resistance related disorders, Diabetes Mellitus (such as, for example, Type 2 Diabetes), glucose intolerance, abnormal lipid metabolism, hyperglycemia, dyslipidemia, high cholesterol, elevated LDL-cholesterol, decreased HDL-cholesterol, elevated triglycerides, adipose tissues inflammation and adipose tissues fibrosis.

In one embodiment, at least one bacterium of the invention and/or a variant thereof and/or fragments thereof, the composition, the pharmaceutical composition, the medicament or the therapeutic combination product of the invention is for, or for use in, the treatment and/or prevention of metabolic diseases selected from the group comprising, or consisting of, obesity, metabolic syndrome, insulin-deficiency or insulin-resistance related disorders, Diabetes Mellitus, type 2 diabetes, type 1 diabetes, glucose intolerance, hyperglycemia, abnormal lipid metabolism, dyslipidemia, high cholesterol, elevated. LDL-cholesterol, decreased LDL cholesterol, elevated triglycerides, adipose tissues inflammation and adipose tissue fibrosis.

In one embodiment, the disorder related to the gastrointestinal microbiota is a metabolic disease, preferably selected from the group comprising, or consisting of, obesity, Diabetes Mellitus, preferably Type 2 Diabetes Mellitus, metabolic syndrome, insulin-deficiency or insulin-resistance related disorders and glucose intolerance.

In one embodiment, the disorder related to the gastrointestinal microbiota is obesity. In one embodiment, the disorder related to the gastrointestinal microbiota is Type 2 Diabetes Mellitus.

In one embodiment, the disorder related to the gastrointestinal microbiota is a metabolic disease, preferably selected from the group comprising, or consisting of, abnormal lipid metabolism, hyperglycemia, dyslipidemia, high cholesterol, elevated LDL-cholesterol, decreased HDL-cholesterol and elevated triglycerides.

In one embodiment, the disorder related to the gastrointestinal microbiota is an infection.

In one embodiment, the disorder related to the gastrointestinal microbiota is colitis, preferably selected from the group comprising, or consisting of, inflammatory bowel disease (e.g., Crohn's disease and ulcerative colitis), ischemic colitis, irritable bowel syndrome, lymphocytic colitis and collagenous colitis.

In one embodiment, the disorder related to the gastrointestinal microbiota is cancer, preferably colorectal cancer.

In one embodiment, the disorder related to the gastrointestinal microbiota is a dysfunction of the immune system, preferably selected from the group comprising eczema, allergies, food allergies and celiac disease.

In one embodiment, the disorder related to the gastrointestinal microbiota is selected from the group comprising, or consisting of, food allergies and celiac disease.

In one embodiment, the disorder related to the gastrointestinal microbiota is a psychological disorder, preferably selected from the group comprising, or consisting of, stress, anxiety, and addiction.

In one embodiment, the disorder related to the gastrointestinal microbiota is a neurological disorder, preferably selected from the group comprising, or consisting of, Parkinson's disease and Alzheimer's disease.

In one embodiment, the disorder related to the gastrointestinal microbiota is a liver disease, preferably selected from the group comprising, or consisting of, cirrhosis, non-alcoholic fatty liver disease, and hepatic steatosis.

In one embodiment, the disorder related to the gastrointestinal microbiota is cachexia.

In one embodiment, the disorder related to the gastrointestinal microbiota is Prader-Willy syndrome.

In one embodiment, the disorder related to the gastrointestinal microbiota is a dysfunction of the digestive tract, preferably selected from the group comprising, or consisting of, ulcers and gallbladder disease.

In one embodiment, the disorder related to the gastrointestinal microbiota is a feeding behavior disorder preferably selected from the group comprising, or consisting of, anorexia nervosa, bulimia nervosa and binge-eating disorder.

In one embodiment, the disorder related to the gastrointestinal microbiota is a cardiovascular disease or condition, preferably selected from the group comprising, or consisting of, strokes, atherosclerosis and hypertension.

In one embodiment, at least one bacterium of the invention and/or a variant thereof and/or fragments thereof, the composition, the pharmaceutical composition, the medicament or the therapeutic combination product of the invention is for, or for use in, the treatment and/or prevention of inflammatory diseases. In one embodiment, the inflammatory disease is selected form the group comprising, or consisting of, adipose tissue inflammation, adipose tissue dysfunction, colitis and enteritis.

The inventors have observed that the presence of the bacteria of the invention in the gut microbiota promote the integrity of the gut epithelial barrier. Beyond its importance in metabolic function, notably in type 1 diabetes, a decrease in the integrity of the gut epithelial barrier has been found associated with several other diseases such as infection, colitis, enteritis, eczema, allergies, food allergies, liver diseases, inflammatory bowel diseases (e.g., Crohn's disease and ulcerative colitis), celiac disease, and psychological disorders (e.g., anxiety, stress and addiction).

The present invention thus further relates to the bacterium of the invention and/or a variant thereof and/or fragments thereof, or to the composition, pharmaceutical composition, medicament or therapeutic combination product of the invention for, or for use in, the treatment and/or prevention of a disease related to an increased epithelial barrier permeability. Examples of diseases related to an increased epithelial barrier permeability include, but are not limited to, infection, colitis, enteritis, type I diabetes, eczema, allergies, food allergies, liver diseases, inflammatory bowel diseases (e.g., Crohn's disease and ulcerative colitis), celiac disease, and psychological disorders (e.g., anxiety, stress and addiction).

In one embodiment, at least one bacterium of the invention and/or a variant thereof and/or fragments thereof, the composition, the pharmaceutical composition, the medicament or the therapeutic combination product of the invention is for, or for use in, the treatment of diseases related to the integrity of the intestinal epithelial barrier. In one embodiment, diseases related the integrity of the intestinal epithelial barrier are selected form the group comprising, or consisting of, infections, colitis, inflammatory bowel disease, Crohn's disease, ulcerative colitis, ischemic colitis, irritable bowel syndrome, lymphocytic colitis, collagenous colitis, enteritis, celiac diseases and food allergies.

The present invention relates to a method for treating and/or preventing a disorder selected from the group consisting of metabolic diseases, obesity, metabolic syndrome, insulin-deficiency or insulin-resistance related disorders, Diabetes Mellitus, type 2 diabetes, type 1 diabetes, glucose intolerance, hyperglycemia, abnormal lipid metabolism, dyslipidemia, high cholesterol, elevated LDL-cholesterol, decreased LDL cholesterol, elevated triglycerides, adipose tissues inflammation, adipose tissue fibrosis, infections, colitis, inflammatory bowel disease, Crohn's disease, ulcerative colitis, ischemic colitis, irritable bowel syndrome, lymphocytic colitis, collagenous colitis, enteritis, cancers, colorectal cancer, dysfunction of the immune system, eczema, allergies, food allergies, celiac disease, psychological disorders, stress, anxiety, addiction, neurological disorders, Parkinson's disease, Alzheimer's disease, liver diseases, cirrhosis, non-alcoholic fatty liver disease, hepatic steatosis, cachexia, Prader-Willy syndrome, dysfunction of the digestive tract, ulcers, gallbladder disease, feeding behaviors disorders, anorexia nervosa, bulimia nervosa, binge-eating disorder, cardiovascular diseases, strokes, atherosclerosis and hypertension, asthma, sleep apnea, osteoarthritis and inflammatory diseases in a subject, comprising administering to the subject at least one bacterium of the invention and/or a variant thereof and/or at least one fragment thereof.

The present invention relates to a method for treating and/or preventing a disorder selected from the group consisting of metabolic diseases, obesity, metabolic syndrome, insulin-deficiency or insulin-resistance related disorders, Diabetes Mellitus, type 2 diabetes, type 1 diabetes, glucose intolerance, hyperglycemia, abnormal lipid metabolism, dyslipidemia, high cholesterol, elevated LDL-cholesterol, decreased LDL cholesterol, elevated triglycerides, adipose tissues inflammation, adipose tissue fibrosis, infections, colitis, inflammatory bowel disease, Crohn's disease, ulcerative colitis, ischemic colitis, irritable bowel syndrome, lymphocytic colitis, collagenous colitis, enteritis, food allergies, celiac disease, ulcers, cachexia, Prader-Willy syndrome, feeding behaviors disorders and binge-eating disorder in a subject, comprising administering to the subject at least one bacterium of the invention and/or a variant thereof and/or at least one fragment thereof.

The present invention relates to a method for treating and/or preventing a disorder selected from the group consisting of metabolic diseases, infections, colitis, enteritis, food allergies, celiac disease, ulcers, cachexia, Prader-Willy syndrome and feeding behaviors disorders in a subject, comprising administering to the subject at least one bacterium of the invention and/or a variant thereof and/or at least one fragment thereof.

The present invention relates to a method for treating and/or preventing a metabolic disease in a subject, comprising administering to the subject at least one bacterium of the invention and/or a variant thereof and/or at least one fragment thereof. In one embodiment, the method is for treating and/or preventing a disease selected from the group comprising, or consisting of, obesity, Diabetes Mellitus, preferably Type 2 Diabetes Mellitus, metabolic syndrome, insulin-deficiency or insulin-resistance related disorders and glucose intolerance.

In one embodiment, the method is for treating and/or preventing obesity in a subject in need thereof. In one embodiment, the method is for treating and/or preventing Type 2 Diabetes Mellitus, in a subject in need thereof.

The present invention relates to a method for treating and/or preventing a disorder related to the integrity of the intestinal epithelial barrier preferably selected from the group consisting of infections, colitis, inflammatory bowel disease, Crohn's disease, ulcerative colitis, ischemic colitis, irritable bowel syndrome, lymphocytic colitis, collagenous colitis, enteritis, celiac diseases and food allergies in a subject, comprising administering to the subject at least one bacterium of the invention and/or a variant thereof and/or at least one fragment thereof.

In one embodiment, the subject is a human.

In one embodiment, the subject is/was diagnosed with a disorder related to the gastrointestinal microbiota.

In one embodiment, the subject is at risk of developing a disorder related to the gastrointestinal microbiota. Examples of risk factors may include, without limitation, the fact that the subject is overweight or obese, or a predisposition, such as, for example, a familial predisposition to such disorder.

In one embodiment, the subject is obese. As used herein, the term "obese" refers herein to a medical condition wherein the subject preferably has a BMI above about 30, preferably above about 35, more preferably above about 40.

The "BMI" or "body mass index" is defined as the subject's body mass in kilograms divided by the square of his height in meters. The formulae universally used in medicine produce a unit of measure of $kg/m^2$.

The inventors have estimated that the proportion of the bacteria of the invention present in the gut microbiota of a substantially healthy subject ranges from about 0.1% to 5%; preferably from about 0.5% to 4% of the total bacteria found in the feces of the subject, more preferably from about 0.8% to 3%. In one embodiment, the proportion of the bacteria of the invention present in the gut microbiota of a substantially healthy subject is about 2.45% of the total bacteria found in the feces of the subject.

In one embodiment of the invention, the subject presents a deregulation of the gut microbiota composition. Preferably, the gut microbiota of said subject is depleted in the bacterium of the invention, more preferably as compared to the gut microbiota of a substantially healthy subject.

In one embodiment, the bacterium of the invention and/or a variant thereof and/or fragments thereof, the composition, the pharmaceutical composition, the medicament or the therapeutic combination product of the invention is to be administered at a dose determined by the skilled artisan and personally adapted to each subject.

In addition, the specific therapeutically effective amount for any particular subject will depend upon a variety of factors including the specific composition employed, the age, body weight, general health, sex and diet of the subject; the time of administration, route of administration, the duration of the treatment; drugs used in combination or coincidental with the composition of the invention; and like factors well known in the medical, nutraceutical and cosmetic arts.

In one embodiment, a therapeutically effective amount of the bacterium of the invention and/or a variant thereof and/or fragments thereof, the composition, the pharmaceutical composition, the medicament or the therapeutic combination product of the invention is to be administered at least once a day, at least twice a day, at least three times a day.

In one embodiment, a therapeutically effective amount of the bacterium of the invention and/or a variant thereof and/or fragments thereof, the composition, the pharmaceutical composition, the medicament or the therapeutic combination product of the invention is to be administered every two, three, four, five, six days.

In one embodiment, a therapeutically effective amount of the bacterium of the invention and/or a variant thereof and/or fragments thereof, the composition, the pharmaceutical composition, the medicament or the therapeutic combination product of the invention is to be administered twice a week, every week, every two weeks, once a month.

In one embodiment, a therapeutically effective of the bacterium of the invention and/or a variant thereof and/or fragments thereof, the composition, the pharmaceutical composition, the medicament or the therapeutic combination product of the invention is to be administered every month, every two months, every three months, every four months, every five months, every six months, once a year.

In one embodiment, a therapeutically effective of the bacterium of the invention and/or a variant thereof and/or fragments thereof, the composition, the pharmaceutical composition, the medicament or the therapeutic combination product of the invention is to be administered for a period of time of about one day, two days, three days, four days, five days, six days, a week, two weeks, three weeks, a month, two months, three months, six months, a year, or over longer periods such as, e.g., for several years or for the rest of the life of the subject.

In one embodiment, when a therapeutic combination product of the invention is to be administered to the subject, each part of said combination product may be administered at a different frequency and for a different period of time.

The specific therapeutically effective amount for any particular subject will depend upon a variety of factors including the disease being treated and the severity of the disease. For example, it is well within the skill of the art to start doses of a therapeutic compound at levels lower than those required to achieve the desired therapeutic effect and to gradually increase the dosage until the desired effect is achieved; but, at the opposite, it can be equally useful to start with a loading dose, a manner to reach steady-state plasma concentration more quickly (also referred to as a bolus), and then, optionally, to follow with a maintenance dose calculated to exactly compensate the effect of the elimination process.

It will be understood that the total daily usage of the bacterium of the invention and/or a variant thereof and/or fragments thereof, the composition, the pharmaceutical composition, the medicament or the therapeutic combination product of the invention will be decided by the attending physician within the scope of sound medical judgment.

In one embodiment, a therapeutically effective amount of the bacterium of the invention and/or a variant thereof and/or fragments thereof, or of the composition, the pharmaceutical composition, the medicament or the therapeutic combination product of the invention is to be administered until treatment or alleviation of the disorder related to the gastrointestinal microbiota; or until the desired therapeutic effect has been achieved.

Examples of desired therapeutic effect relating to the administration of the bacteria of the invention include, but are not limited to, restoration of a normal proportion of the bacterium of the invention in the gut of a subject, preferably defined by the proportion of the bacterium of the invention measured in the gut of a substantially healthy subject, an increase in the proportion of the bacterium of the invention in the gut of a subject, an increase of the abundance of any active compounds of the bacterium of the invention in the gut of a subject, a decrease of glucose intolerance, a decrease of insulin resistance, a decrease of the permeability of the gut intestinal barrier, an increase of the expression level of genes involved in the establishment and/or maintenance of the epithelial barrier, such as genes coding for occludins, claudins, junctional adhesion molecules (JAM), E-cadherin, catenins, nectin, afadin, zonulin and zonula occludens (ZO)-1, ZO-2 and ZO-3, an increase in the secretion of mucus by the intestinal epithelium, an increase of the level of pro-glucagon, glucagon-like peptide 1 (GLP-1) and/or glucagon-like peptide 2 (GLP-2), a reduction of diet-induced fasting hyperglycemia, an inhibition and/or an activation of the growth and/or biological activity of other microorganisms of the gut microbiota in a subject, an assistance in the defense against exogenous pathogenic bacteria, an assistance in digestion and an increase in the production of antibacterial compound, vitamins, SCFA, acetate, acetic acid, propionate, propionic acid, isopropionate, isopropionic acid valerate, valeric acid, isovalerate, isovaleric acid, isobutyrate, isobutyric acid, butyrate and/or butyric acid in the gut of a subject.

In one embodiment, a therapeutically effective amount of the bacterium of the invention and/or a variant thereof and/or fragments thereof, the composition, the pharmaceutical composition, the medicament or the therapeutic combination product of the invention is to be administered for a chronic treatment. In another embodiment, a therapeutically effective amount of the bacterium of the invention and/or a variant thereof and/or fragments thereof, the composition, the pharmaceutical composition the medicament, or the therapeutic combination product of the invention is to be administered for an acute treatment.

In one embodiment the therapeutically effective amount of the bacterium of the invention and/or a variant thereof administered per day is ranging from about $1 \cdot 10^2$ to about $1 \cdot 10^{15}$ cfu/day, preferably from about $1 \cdot 10^5$ to about $1 \cdot 10^{12}$ cfu/day, more preferably from about $1 \cdot 10^8$ to about $1 \cdot 10^{10}$ cfu/day, and even more preferably from about $1 \cdot 10^9$ to about $1 \cdot 10^{10}$ cfu/day. In one embodiment the therapeutically effective amount of the bacterium of the invention and/or a variant thereof administered per day is ranging from about $1 \cdot 10^7$ to about $1 \cdot 10^{10}$ cfu/day, preferably from about $1 \cdot 10^8$ to about $1 \cdot 10^9$ cfu/day.

In one embodiment the therapeutically effective amount of the bacterium of the invention administered per day is ranging from about $1 \cdot 10^6$ to about $1 \cdot 10^{10}$ cfu/day, preferably from about $1 \cdot 10^8$ to about $1 \cdot 10^{10}$ cfu/day, more preferably from about $1 \cdot 10^9$ to about $1 \cdot 10^{10}$ cfu/day.

In one embodiment the therapeutically effective amount of the bacterium of the invention administered per day is ranging from about $1 \cdot 10^6$ to about $1 \cdot 10^{11}$ cfu/day, preferably from about $1 \cdot 10^8$ to about $1 \cdot 10^{11}$ cfu/day, more preferably from about $1 \cdot 10^{10}$ to about $1 \cdot 10^{11}$ cfu/day.

In one embodiment the therapeutically effective amount of the bacterium of the invention and/or a variant thereof administered per day is ranging from about $1 \cdot 10^2$ to about $1 \cdot 10^{15}$ cells/day, preferably from about $1 \cdot 10^5$ to about $1 \cdot 10^{12}$ cells/day, more preferably from about $1 \cdot 10^8$ to about $1 \cdot 10^{11}$ cells/day, and even more preferably from about $1 \cdot 10^9$ to about $1 \cdot 10^{10}$ cells/day. In one embodiment the therapeutically effective amount of the bacterium of the invention and/or a variant thereof administered per day is ranging from about $1 \cdot 10^8$ to about $1 \cdot 10^{11}$ cells/day, preferably from about $5 \cdot 10^8$ to about $5.10^{10}$ cells/day.

In one embodiment the therapeutically effective amount of the bacterium of the invention administered per day is ranging from about $1 \cdot 10^6$ to about $1 \cdot 10^{10}$ cells/day, preferably from about $1 \cdot 10^8$ to about $1 \cdot 10^{10}$ cells/day, more preferably from about $1 \cdot 10^9$ to about $1 \cdot 10^{10}$ cells/day.

In one embodiment the therapeutically effective amount of the bacterium of the invention administered per day is ranging from about $1 \cdot 10^6$ to about $1 \cdot 10^{11}$ cells/day, preferably from about $1 \cdot 10^8$ to about $1 \cdot 10^{11}$ cells/day, more preferably from about $1 \cdot 10^{10}$ to about $1 \cdot 10^{11}$ cells/day.

In one embodiment the therapeutically effective amount of fragment of the bacterium of the invention administered per day corresponds to an amount of bacterium of the invention and/or a variant thereof ranging from about $1 \cdot 10^2$ to about $1 \cdot 10^{15}$ cfu/day, preferably from about $1 \cdot 10^5$ to about $1 \cdot 10^{12}$ cfu/day, more preferably from about $1 \cdot 10^8$ to about $1 \cdot 10^{10}$ cfu/day, and even more preferably from about $1 \cdot 10^9$ to about $1 \cdot 10^{10}$ cfu/day. In one embodiment the therapeutically effective amount of fragment of the bacterium of the invention administered per day corresponds to an amount of bacterium of the invention and/or a variant thereof ranging from about $1 \cdot 10^7$ to about $1 \cdot 10^{10}$ cfu/day, preferably from about $1 \cdot 10^8$ to about $1 \cdot 10^9$ cfu/day.

In one embodiment the therapeutically effective amount of fragment of the bacterium of the invention administered per day corresponds to an amount of bacterium of the invention ranging from about $1 \cdot 10^6$ to about $1 \cdot 10^{10}$ cfu/day, preferably from about $1 \cdot 10^8$ to about $1 \cdot 10^{10}$ cfu/day, more preferably from about $1 \cdot 10^9$ to about $1 \cdot 10^{10}$ cfu/day.

In one embodiment the therapeutically effective amount of fragment of the bacterium of the invention administered per day corresponds to an amount of bacterium of the invention ranging from about $1 \cdot 10^6$ to about $1 \cdot 10^{11}$ cfu/day, preferably from about $1 \cdot 10^8$ to about $1 \cdot 10^{11}$ cfu/day, more preferably from about $1 \cdot 10^{10}$ to about $1 \cdot 10^{11}$ cfu/day.

In one embodiment the therapeutically effective amount of fragment of the bacterium of the invention administered per day corresponds to an amount of bacterium of the invention and/or a variant thereof ranging from about $1 \cdot 10^2$ to about $1 \cdot 10^{15}$ cells/day, preferably from about $1 \cdot 10^5$ to about $1 \cdot 10^{12}$ cells/day, more preferably from about $1 \cdot 10^8$ to about $1 \cdot 10^{11}$ cells/day, and even more preferably from about $1 \cdot 10^9$ to about $1 \cdot 10^{10}$ cells/day. In one embodiment the therapeutically effective amount of fragment of the bacterium of the invention administered per day corresponds to an amount of bacterium of the invention and/or a variant thereof ranging from $1 \cdot 10^8$ to about $1 \cdot 10^{11}$ cells/day, preferably from about $5 \cdot 10^8$ to about $5.10^{10}$ cells/day.

In one embodiment the therapeutically effective amount of fragment of the bacterium of the invention administered per day corresponds to an amount of bacterium of the invention ranging from about $1 \cdot 10^6$ to about $1 \cdot 10^{10}$ cells/day, preferably from about $1 \cdot 10^8$ to about $1 \cdot 10^{10}$ cells/day, more preferably from about $1 \cdot 10^9$ to about $1 \cdot 10^{10}$ cells/day.

In one embodiment the therapeutically effective amount of fragment of the bacterium of the invention administered per day corresponds to an amount of bacterium of the invention ranging from about $1 \cdot 10^6$ to about $1 \cdot 10^{11}$ cells/day, preferably from about $1 \cdot 10^8$ to about $1 \cdot 10^{11}$ cells/day, more preferably from about $1 \cdot 10^{10}$ to about $1 \cdot 10^{11}$ cells/day.

The present invention also relates to the nutraceutical use of at least one bacterium of the invention and/or a variant thereof and/or a fragment thereof for obtaining a physiological benefit, improving well-being or alleviating a discomfort in a subject.

The present invention further relates to the cosmetic use of at least one bacterium of the invention and/or a variant thereof and/or a fragment thereof to ameliorate the perception, by the subject and/or by others, of the appearance of the subject.

In one embodiment, the composition of the invention is in the form of a food additive, drink additive, dietary supplement, nutritional product, medical food or nutraceutical composition.

The present invention further relates to a nutraceutical composition comprising the composition according to the invention and at least one nutraceutically acceptable excipient.

The present invention further relates to a cosmetic composition comprising the composition according to the invention and at least one cosmetically acceptable excipient.

In the nutraceutical or cosmetic composition of the present invention, the bacterium of the invention and/or a variant thereof and/or fragment thereof, alone or in combination with another active principle, can be administered in a unit administration form, as a mixture with conventional supports, to animals and human beings. Suitable unit administration forms comprise oral-route forms such as tablets, gel capsules, powders, granules and oral suspensions or solutions, sublingual and buccal administration forms, aerosols, implants, subcutaneous, transdermal, topical, intraperitoneal, intramuscular, intravenous, subdermal, intrathecal, intranasal and rectal administration forms.

In one embodiment, the nutraceutical or cosmetic composition according to the present invention can be used as dietary supplement to food and beverages.

The nutraceutical or cosmetic composition according to the present invention may further contain protective hydrocolloids (such as gums, proteins, modified starches), binders, film-forming agents, encapsulating agents/materials, wall/shell materials, matrix compounds, coatings, emulsifiers, surface active agents, solubilizing agents (oils, fats, waxes, lecithins etc.), adsorbents, carriers, fillers, co-compounds, dispersing agents, wetting agents, processing aids (solvents), flowing agents, taste-masking agents, weighting agents, jellifying agents, gel-forming agents, antioxidants and antimicrobials.

Moreover, a multi-vitamin and mineral supplement may be added to the nutraceutical or cosmetic compositions of the present invention to obtain an adequate amount of an essential nutrient, which is missing in some diets. The multi-vitamin and mineral supplement may also be useful for disease prevention and protection against nutritional losses and deficiencies due to lifestyle patterns.

The nutraceutical or cosmetic compositions according to the present invention may be in any galenic form that is suitable for administering to the body, especially in any form that is conventional for oral administration, In one embodiment, the nutraceutical or cosmetic composition of the invention is to be orally administered.

Examples of formulations adapted to oral administration include, but are not limited to, solid forms, liquid forms and gels. Examples of solid forms adapted to oral administration include, but are not limited to, pill, tablet, capsule, soft gelatine capsule, hard gelatine capsule, dragees, granules, caplet, compressed tablet, cachet, wafer, sugar-coated pill, sugar coated tablet, or dispersing/or disintegrating tablet, powder, solid forms suitable for solution in, or suspension in, liquid prior to oral administration and effervescent tablet. Examples of liquid form adapted to oral administration include, but are not limited to, solutions, suspensions, drinkable solutions, elixirs, sealed phial, portion, drench, syrup, liquor and sprays.

Other examples of solid forms adapted to oral administration include, but are not limited to, (additives/supplements for) food or feed, food or feed premix, fortified food or feed, tablets, pills, granules, dragees, capsules and effervescent formulations, such as powders and tablets.

Other examples of liquid forms adapted to oral administration include, but are not limited to, solutions, emulsions or suspensions such as, e.g., beverages, pastes and oily suspensions. The pastes may be incorporated in hard- or soft-shell capsules, whereby the capsules feature, e.g., a matrix of (fish, swine, poultry, cow) gelatine, plant proteins or ligninsulfonate.

In one embodiment of the invention, the composition, the nutraceutical composition or the cosmetic composition of the invention is in the form of a nutritional composition, i.e., comprises liquid or solid food, feed or drinking water. In one embodiment of the invention, the composition, the nutraceutical composition or the cosmetic composition of the invention is a food product, such as, for example, dairy products, dairy drinks, yogurt, fruit or vegetable juice or concentrate thereof, powders, malt or soy or cereal based beverages, breakfast cereal such as muesli flakes, fruit and vegetable juice powders, cereal and/or chocolate bars, confectionary, spreads, flours, milk, smoothies, confectionary, milk product, milk powder, reconstituted milk, cultured milk, yoghurt, drinking yoghurt, set yoghurt, drink, dairy drink, milk drink, chocolate, gels, ice creams, cereals, reconstituted fruit products, snack bars, food bars, muesli bars, spreads, sauces, dips, dairy products including yoghurts and cheeses, drinks including dairy and non-dairy based drinks, sports supplements including dairy and non-dairy based sports supplements.

Examples of food are dairy products including, but not limited to, margarines, spreads, butter, cheese, sausage, sauce, yoghurts, milk-drinks, ice cream, gums, chewing gum, gummi candy, taffy, caramel candy, fudge and hard candy.

Examples of fortified food include, but are not limited to, sweet corn, bread, cereal bars, bakery items, such as cakes, pies and cookies, and potato chips or crisps.

Beverages encompass non-alcoholic and alcoholic drinks as well as liquid preparations to be added to drinking water and liquid food. Non-alcoholic drinks include, but are not limited to, soft drinks, sports drinks, energy drinks, fruit juices, lemonades, sodas, teas and milk-based drinks. Liquid foods include, but are not limited to, soups and dairy products.

In one embodiment, the composition, the nutraceutical composition or the cosmetic composition of the invention further comprises additional probiotic strains or species, such as, for example, bacterial probiotic strains or species; prokaryotes probiotics other than bacteria; or fungal strains or species, preferably yeast strains or species. In one embodiment, said additional probiotic strains or species are selected from those naturally present in the gut of the subject, preferably in the human gut, more preferably in the gut of substantially healthy human subjects. Examples of probiotic strains are listed hereinabove.

In one embodiment, the composition, nutraceutical composition or the cosmetic composition of the invention further comprises a prebiotic. Examples of prebiotic compounds are listed hereinabove.

The present invention also relates to a nutraceutical or cosmetic combination product for its separate, simultaneous or sequential administration.

As used herein the term "nutraceutical or cosmetic combination product" (that may also be referred to as a nutraceutical or cosmetic kit of parts) refers to a product comprising or consisting of at least the 2 following parts: a first part comprising (preferably in a nutraceutically or cosmetically effective affective amount) a bacterium of the invention and/or a variant thereof, a composition according to the invention, a nutraceutical composition according to the invention, or a cosmetic composition according to the invention and a second part comprising a composition comprising a least one probiotic and/or at least one prebiotic.

In one embodiment, the at least two parts of a nutraceutical or cosmetic combination product according to the invention are administered simultaneously. In another embodiment, the at least two parts of the nutraceutical or cosmetic combination product according to the invention are administered at a different time. In another embodiment, the at least two parts of the nutraceutical or cosmetic combination product according to the invention are administered sequentially.

In one embodiment, the at least two parts of the nutraceutical or cosmetic combination product according to the invention are administered using different administration routes. (such as, for example, one part by oral administration, and the second one by injection). In another embodiment, the at least two parts of the nutraceutical or cosmetic combination product according to the invention are administered using the same administration route (such as, for example, oral administration or injection).

The present invention further relates to non-therapeutic methods for improving well-being, obtaining a physiological, and/or obtaining a cosmetic benefit in a subject, wherein said methods comprise administering to the subject at least one bacterium of the invention and/or a variant thereof and/or fragments thereof, or the composition, nutraceutical composition or combination product, or cosmetic composition or combination product of the invention.

The present invention thus relates to the nutraceutical or cosmetic use of the bacterium of the invention and/or a variant thereof and/or fragments thereof.

In one embodiment, the method of the invention comprises administering a cosmetically effective amount of the bacteria of the invention and/or fragment thereof, of the composition or the cosmetic composition of the invention to the subject.

In one embodiment, the method of the invention comprises administering a nutraceutically effective amount of the bacteria of the invention and or fragment thereof, or of the composition or the nutraceutical composition or combination product of the invention to the subject.

As used herein, the term "physiological benefit" refers to an increase in the efficiency of a physiological function in a subject, or a partial or complete alleviation of a discomfort in a subject.

As used herein, the term "well-being" refers to an amelioration of the perception by the subject of his own health status.

As used herein, the term "cosmetic benefit" refers to an amelioration of the perception, by the subject and/or by others, of the appearance of the subject.

In one embodiment, the method of the invention is a method for improving well-being in a subject. The present invention thus relates to the use of the bacterium of the invention and/or a variant thereof and/or fragments thereof for improving well-being in a subject.

In one embodiment, the method of the invention is a method for promoting weight loss in a subject. The present invention thus relates to the use of the bacterium of the invention and/or a variant thereof and/or fragments thereof for promoting weight loss in a subject.

In one embodiment, the method of the invention is a method for decreasing food intake in a subject. The present invention thus relates to the use of the bacterium of the invention and/or a variant thereof and/or fragments thereof for decreasing food intake in a subject.

In one embodiment, the method of the invention is a method for increasing muscle mass in a subject. The present invention thus relates to the use of the bacterium of the invention and/or a variant thereof and/or fragments thereof for increasing muscle mass in a subject.

In one embodiment, the method of the invention is a method for decreasing fat mass in a subject. The present invention thus relates to the use of the bacterium of the invention and/or a variant thereof and/or fragments thereof for decreasing fat mass in a subject. In one embodiment, the bacterium of the invention and/or a variant thereof and/or fragments thereof decreases abnormal fat accumulation, altered lipolysis, and high-fat storage. In one embodiment, the bacterium of the invention and/or a variant thereof and/or fragments thereof increases lipolysis.

In one embodiment, the method of the invention is a method for increasing satiety in a subject. The present invention thus relates to the use of the bacterium of the invention and/or a variant thereof and/or fragments thereof for increasing satiety in a subject.

In one embodiment, the method of the invention is a method for decreasing the weight gain associated with food intake in a subject. The present invention thus relates to the use of the bacterium of the invention and/or a variant thereof and/or fragments thereof for decreasing the weight gain associated with food intake in a subject.

In one embodiment, the method of the invention is a method for decreasing the intestinal absorption associated with food intake in a subject. The present invention thus relates to the use of the bacterium of the invention and/or a variant thereof and/or fragments thereof for decreasing the intestinal absorption associated with food intake in a subject.

In one embodiment, the subject is substantially healthy, in particular in respect to disorder related to the gut microbiota.

In one embodiment, the subject is not obese. In one embodiment, the subject has a BMI lower than about 40, preferably lower than about 35, more preferably lower than about 30. In one embodiment, the subject is not overweight. In one embodiment the subject has a BMI lower than about than about 30, more preferably lower than about 25.

In one embodiment, the bacterium of the invention and/or a variant thereof and/or fragments thereof, the composition, the nutraceutical composition or combination product or the cosmetic composition or combination product of the invention is to be administered at a dose determined by the skilled artisan and personally adapted to each subject.

In addition, the specific nutraceutically or cosmetically effective amount for any particular subject will depend upon a variety of factors including the specific composition employed, the age, body weight, general health, sex and diet of the subject; the time of administration, route of administration, the duration of the treatment; drugs used in combination or coincidental with the composition of the invention; and like factors well known in the medical, nutraceutical and cosmetic arts.

In one embodiment, a nutraceutically or cosmetically effective amount of the bacterium of the invention and/or a variant thereof and/or fragments thereof, or of the composition, the nutraceutical composition or combination product, or the cosmetic composition or combination product of the invention is to be administered at least once a day, at least twice a day, at least three times a day.

In one embodiment, a nutraceutically or cosmetically effective amount of the bacterium of the invention and/or a variant thereof and/or fragments thereof, or of the composition, the nutraceutical composition or combination product, or the cosmetic composition or combination product of the invention is to be administered every two, three, four, five, six days.

In one embodiment, a nutraceutically or cosmetically effective amount of the bacterium of the invention and/or a variant thereof and/or fragments thereof, or of the composition, the nutraceutical composition or combination product, or the cosmetic composition or combination product of the invention is to be administered twice a week, every week, every two weeks, once a month.

In one embodiment, a nutraceutically or cosmetically effective amount of the bacterium of the invention and/or a variant thereof and/or fragments thereof, or of the composition, the nutraceutical composition or combination product, or the cosmetic composition or combination product of the invention is to be administered every month, every two months, every three months, every four months, every five months, every six months, once a year.

In one embodiment, a nutraceutically or cosmetically effective amount of the bacterium of the invention and/or a variant thereof and/or fragments thereof, or of the composition, the nutraceutical composition or combination product, or the cosmetic composition or combination product of the invention is to be administered for a period of time of about one day, two days, three days, four days, five days, six days, a week, two weeks, three weeks, a month, two months, three months, six months, a year, or over longer periods such as, e.g., for several years or for the rest of the life of the subject.

In one embodiment, when a nutraceutical or cosmetic combination product of the invention is to be administered to the subject, each part of said combination product may be administered at a different frequency and for a different period of time.

In one embodiment, a nutraceutically or cosmetically effective amount of the bacterium of the invention and/or a variant thereof and/or fragments thereof, or of the composition, the nutraceutical composition or combination product or the cosmetic composition or combination product of the invention is to be administered until the desired physiological or cosmetic benefit has been achieved.

Example of physiological or cosmetic benefits include, but is not limited to, an improvement of well-being, weight loss, increase in muscle mass, reduction of fat mass, reduction of food intake, increase in satiety, decrease in the weight gain associated with food intake, decrease of the intestinal absorption associated with food intake.

In one embodiment the nutraceutically or cosmetically effective amount of the bacterium of the invention and/or a variant thereof administered per day is ranging from about $1 \cdot 10^2$ to about $1 \cdot 10^{15}$ cfu/day, preferably from about $1 \cdot 10^5$ to about $1 \cdot 10^{12}$ cfu/day, more preferably from about $1 \cdot 10^8$ to about $1 \cdot 10^{10}$ cfu/day, and even more preferably from about $1 \cdot 10^9$ to about $1 \cdot 10^{10}$ cfu/day. In one embodiment the nutraceutically or cosmetically effective amount of the bacterium of the invention and/or a variant thereof administered per day is ranging from about $1 \cdot 10^7$ to about $1 \cdot 10^{11}$ cfu/day, preferably from about $1 \cdot 10^8$ to about $1 \cdot 10^{10}$ cfu/day.

In one embodiment the nutraceutically or cosmetically effective amount of the bacterium of the invention administered per day is ranging from about $1 \cdot 10^6$ to about $1 \cdot 10^{10}$ cfu/day, preferably from about $1 \cdot 10^8$ to about $1 \cdot 10^{10}$ cfu/day, more preferably from about $1 \cdot 10^9$ to about $1 \cdot 10^{10}$ cfu/day.

In one embodiment nutraceutically or cosmetically effective amount of the bacterium of the invention administered per day is ranging from about $1 \cdot 10^6$ to about $1 \cdot 10^{11}$ cfu/day, preferably from about $1 \cdot 10^8$ to about $1 \cdot 10^{11}$ cfu/day, more preferably from about $1 \cdot 10^{10}$ to about $1 \cdot 10^{11}$ cfu/day.

In one embodiment the nutraceutically or cosmetically effective amount of the bacterium of the invention and/or a variant thereof administered per day is ranging from about $1 \cdot 10^2$ to about $1 \cdot 10^{15}$ cells/day, preferably from about $1 \cdot 10^5$ to about $1 \cdot 10^{12}$ cells/day, more preferably from about $1 \cdot 10^8$ to about $1 \cdot 10^{10}$ cells/day, and even more preferably from about $1 \cdot 10^9$ to about $1 \cdot 10^{10}$ cells/day. In one embodiment the nutraceutically or cosmetically effective amount of the bacterium of the invention and/or a variant thereof administered per day is ranging from about $1 \cdot 10^8$ to about $1 \cdot 10^{11}$ cells/day, preferably from about $5 \cdot 10^8$ to about $5.10^{10}$ cells/day.

In one embodiment the nutraceutically or cosmetically effective amount of the bacterium of the invention administered per day is ranging from about $1 \cdot 10^6$ to about $1 \cdot 10^{10}$ cells/day, preferably from about $1 \cdot 10^8$ to about $1 \cdot 10^{10}$ cells/day, more preferably from about $1 \cdot 10^9$ to about $1 \cdot 10^{10}$ cells/day.

In one embodiment the nutraceutically or cosmetically effective amount of the bacterium of the invention administered per day is ranging from about $1 \cdot 10^6$ to about $1.10"$ cells/day, preferably from about $1 \cdot 10^8$ to about $1 \cdot 10^{11}$ cells/day, more preferably from about $1 \cdot 10^{10}$ to about $1 \cdot 10^{11}$ cells/day.

In one embodiment the nutraceutically or cosmetically effective amount of fragment of the bacterium of the invention administered per day corresponds to an amount of bacterium of the invention and/or a variant thereof ranging from about $1 \cdot 10^2$ to about $1 \cdot 10^{15}$ cfu/day, preferably from about $1 \cdot 10^5$ to about $1 \cdot 10^{12}$ cfu/day, more preferably from about $1 \cdot 10^8$ to about $1 \cdot 10^{10}$ cfu/day, and even more preferably from about $1 \cdot 10^9$ to about $1 \cdot 10^{10}$ cfu/day. In one embodiment the nutraceutically or cosmetically effective amount of fragment of the bacterium of the invention administered per day corresponds to an amount of bacterium of the invention and/or a variant thereof ranging from about $1 \cdot 10^7$ to about $1 \cdot 10^{11}$ cfu/day, preferably from about $1 \cdot 10^8$ to about $1 \cdot 10^{10}$ cfu/day.

In one embodiment the nutraceutically or cosmetically effective amount of fragment of the bacterium of the invention administered per day corresponds to an amount of bacterium of the invention ranging from about $1 \cdot 10^6$ to about $1 \cdot 10^{10}$ cfu/day, preferably from about $1 \cdot 10^8$ to about $1 \cdot 10^{10}$ cfu/day, more preferably from about $1 \cdot 10^9$ to about $1 \cdot 10^{10}$ cfu/day.

In one embodiment the nutraceutically or cosmetically effective amount of fragment of the bacterium of the invention administered per day corresponds to an amount of bacterium of the invention ranging from about $1 \cdot 10^6$ to about $1 \cdot 10^{11}$ cfu/day, preferably from about $1 \cdot 10^8$ to about $1 \cdot 10^{11}$ cfu/day, more preferably from about $1 \cdot 10^{10}$ to about $1 \cdot 10^{11}$ cfu/day.

In one embodiment the nutraceutically or cosmetically effective amount of fragment of the bacterium of the invention administered per day corresponds to an amount of bacterium of the invention and/or a variant thereof ranging from about $1 \cdot 10^2$ to about $1 \cdot 10^{15}$ cells/day, preferably from about $1 \cdot 10^5$ to about $1 \cdot 10^{12}$ cells/day, more preferably from about $1 \cdot 10^8$ to about $1 \cdot 10^{11}$ cells/day, and even more preferably from about $1 \cdot 10^9$ to about $1 \cdot 10^{10}$ cells/day. In one embodiment the nutraceutically or cosmetically effective amount of fragment of the bacterium of the invention administered per day corresponds to an amount of bacterium of the invention and/or a variant thereof ranging from about $1 \cdot 10^8$ to about $1 \cdot 10^{11}$ cells/day, preferably from about $5 \cdot 10^8$ to about $5.10^{10}$ cells/day.

In one embodiment the nutraceutically or cosmetically effective amount of fragment of the bacterium of the invention administered per day corresponds to an amount of bacterium of the invention ranging from about $1 \cdot 10^6$ to about $1 \cdot 10^{10}$ cells/day, preferably from about $1 \cdot 10^8$ to about $1 \cdot 10^{10}$ cells/day, more preferably from about $1 \cdot 10^9$ to about $1 \cdot 10^{10}$ cells/day.

In one embodiment the nutraceutically or cosmetically effective amount of fragment of the bacterium of the invention administered per day corresponds to an amount of bacterium of the invention ranging from about $1 \cdot 10^6$ to about $1 \cdot 10^{11}$ cells/day, preferably from about $1 \cdot 10^8$ to about $1 \cdot 10^{11}$ cells/day, more preferably from about $1 \cdot 10^{10}$ to about $1 \cdot 10^{11}$ cells/day.

The present invention relates to a method for treating a disorder related to the gastrointestinal microbiota in a subject, comprising administering to the subject at least one bacterium of the invention and/or a variant thereof and/or at least one fragment thereof.

The present invention also relates to a method for restoring and/or enhancing function associated with the gut microbiota in a subject, comprising administering to the subject at least one bacterium of the invention and/or a variant thereof and/or at least one fragment thereof.

The present invention relates to a method for decreasing glucose intolerance and/or insulin resistance in a subject, comprising administering to the subject at least one bacterium of the invention and/or a variant thereof and/or at least one fragment thereof.

The present invention relates to a method for restoring the normal proportion of the bacteria of the invention present in the gut microbiota of a subject in need thereof, comprising administering to the subject at least one bacterium of the invention and/or a variant thereof and/or at least one fragment thereof. In one embodiment, said normal proportion corresponds to the proportion observed in a substantially healthy subject. In one embodiment, said normal proportion ranges from about 0.1% to about 5% of the total bacteria found in the feces of the subject, preferably from about 0.5% to about 4%, more preferably from about 0.8% to about 3% In one embodiment, the normal proportion in a substantially healthy subject is about 2.45% of the total bacteria found in the feces of the subject. In one embodiment, said normal proportion is at least 0.5%, preferably at least 0.6%, 0.7%, 0.8%, 0.85%, 0.90%, 0.95%, 1%, 1.05%, 1.10%, 1.15%, 1.20%, 1.25%, 1.30%, 1.35%, 1.40%, 1.45%, more preferably at least 1.50%, 1.55%, 1.60%, 1.65%, 1.70%, 1.75%, 1.80%, 1.85%, 1.90%, 2%, 2.05%, 2.10%, 2.15%, 2.20%, 2.25%, 2.30%, 2.35%, 2.40% or more of the total bacteria found in the feces of the substantially healthy subject.

Techniques to determine the presence and/or proportion of the bacteria of the invention are known to the skilled artisan and include without limitation: PCR, qPCR, hybridization techniques (FISH, Northern Blot), bacteria identification kit, and DNA or RNA sequencing and techniques of immunodetection.

The present invention relates to a method for decreasing the permeability of the gut intestinal barrier in a subject, comprising administering to the subject at least one bacterium of the invention and/or a variant thereof and/or at least one fragment thereof.

The present invention relates to a method for increasing the expression level of genes involved in the establishment and/or maintenance of the epithelial barrier, such as, for example genes coding for mucins (muc—including but not limited to mucin 2), occludins, claudins (cldn—including but not limited to claudin 3, 4, 7, 15 and 23), defensins (defa—including but not limited to defensin 5, 17, 21, 22, 24, 30, 34), Regenerating islet-derived protein (reg—including but not limited to regenerating islet-derived protein 1, 3a, 3b and 3g) junctional adhesion molecules (JAM), E-cadherin, catenins, nectin, afadin, zonulin and zonula occludens (ZO)-1, ZO-2 and ZO-3, wherein the method of the invention comprises administering to the subject at least one bacterium of the invention and/or at least one fragment thereof.

The present invention relates to a method for increasing the secretion of mucus by the intestinal epithelium, wherein the method of the invention comprises administering to the subject at least one bacterium of the invention and/or a variant thereof and/or at least one fragment thereof.

The present invention relates to a method for increasing the level of proglucagon and/or glucagon-like peptide 1 (GLP-1) and/or glucagon-like peptide 2 (GLP-2) in a subject, comprising administering to the subject at least one bacterium of the invention and/or a variant thereof and/or at least one fragment thereof.

The present invention relates to a method for decreasing fibrosis of the adipose tissues in a subject, comprising administering to the subject at least one bacterium of the invention and/or a variant thereof and/or at least one fragment thereof.

The present invention relates to a method for decreasing the expression of genes involved in fibrosis in the adipose tissues of a subject, preferably genes selected from the group comprising, or consisting of, Thbs2, Col6a2, S100a6, Myoc, Col1a2, Col1a1, Col5a2, Col3a1, Ntn1, Ctsc2, Serpinf1, Adamts4, Col6a1, Anxa1, Nid2, Cilp, Lum and Mmp14, comprising administering to the subject at least one bacterium of the invention and/or a variant thereof and/or at least one fragment thereof.

The present invention relates to a method for decreasing the expression of genes involved in fibrosis in the brown adipose tissues of a subject, preferably genes selected from the group comprising, or consisting of, Thbs2, Col6a2, S100a6, Myoc, Col1a2, Col1a1, Col5a2, Col3a1, Ntn1, Ctsc2, Serpinf1, Adamts4, Col6a1, Anxa1, Nid2, Cilp, Lum, Mmp14, and Col10a, comprising administering to the subject at least one bacterium of the invention and/or a variant thereof and/or at least one fragment thereof.

The present invention relates to a method for decreasing the expression of genes involved in fibrosis in the subcutaneous adipose tissues of a subject, preferably genes selected from the group comprising, or consisting of, Thbs2, Adanzts12, Lum, Cela1, S100a6, Culp, Ctsc2, Serpinf1, Anxa1, Mmp14, Col1a2, Col3a1, Col5a2, Col6a1, Col6a2, Col1a1, Myoc, Nid2, Ntn1 and Adamts4, comprising administering to the subject at least one bacterium of the invention and/or a variant thereof and/or at least one fragment thereof.

The present invention relates to a method for decreasing inflammation of the adipose tissues, preferably brown adipose tissues, in a subject, comprising administering to the subject at least one bacterium of the invention and/or a variant thereof and/or at least fragment thereof.

The present invention relates to a method for decreasing the expression of genes involved in the inflammation of the adipose tissues, preferably brown adipose tissues, of a subject, preferably genes selected from the group comprising, or consisting of, Naip6, Anxa1, Lbp, Cc16, Pycard, F2rl1, Cc19, Smpd13b, Cela1, Tnfrsf1b, Cd51, Ptafr, C3ar1, Pf4, Lox13, Ccr5, Saa3, Ccr1, Adra2a, Tlr13, Ccl2, Alox5, Fcgr1, Ccl7, Ccl8, Ptgs2, Havcr2, Relb2, Ticam2, Stab1, Thenzis2_2, Tlr11, Ptger2, Orm2, Cxcr3, Pxk1, Pelb1, Nlrp10, Ccl12, Ppbp, Cd180, C,cl3, Ptgir2, Ptgir1, Chst1_2, Adma8, Nrros, Ptger1 and Theinis2_1, comprising administering to the subject at least one bacterium of the invention and/or a variant thereof and/or at least one fragment thereof.

The present invention relates to a method for reducing diet-induced fasting hyperglycemia in a subject, comprising administering to the subject at least one bacterium of the invention and/or a variant thereof and/or at least one fragment thereof.

The present invention relates to a method for increasing energy expenditure of a subject comprising administering to the subject at least one bacterium of the invention and/or a variant thereof and/or at least one fragment thereof.

The present invention relates to a method for decreasing energy intestinal absorption of a subject comprising administering to the subject at least one bacterium of the invention and/or a variant thereof and/or at least one fragment thereof.

When sharing the same environment interactions between microorganisms may lead to competitive and/or collaborative effect.

The present invention thus further relates to a method for activating the growth and/or biological activity of other microorganisms of the gut microbiota in a subject, comprising administering to the subject at least one bacterium of the invention and/or a variant thereof and/or at least one fragment thereof.

The present invention also relates to a method for inhibiting the growth and/or biological activity of other microorganisms of the gut microbiota in a subject, comprising administering to the subject at least one bacterium of the invention and/or a variant thereof and/or at least one fragment thereof.

The present invention also relates to a method for assisting in defense against exogenous pathogenic bacteria in a subject, comprising administering to the subject at least one bacterium of the invention and/or a variant thereof and/or at least one fragment thereof.

The present invention relates to a method for increasing the production of antibacterial compound(s) in a subject, comprising administering to the subject at least one bacterium of the invention and/or a variant thereof and/or at least one fragment thereof.

The present invention relates to a method for increasing the production of defensin in a subject, comprising administering to the subject at least one bacterium of the invention and/or a variant thereof and/or at least one fragment thereof.

Bacteria of the gut microbiota participate in the metabolism of their host by participating in the digestion and producing vitamins.

The present invention thus further relates to a method for assisting digestion and/or producing vitamins in a subject, comprising administering to the subject at least one bacterium of the invention and/or a variant thereof and/or at least one fragment thereof.

Butyrate, produced by anaerobe bacteria of the gut microbiota has numerous beneficial effects on the host health on energy metabolism and related metabolic diseases. it also has as an immunomodulatory, antimicrobial and anticarcinogenic effect. Bacteria belonging to the clostridial cluster IV, as the bacterium of the invention are major butyrate producer. Beyond the sole role of butyrate, other short-chain fatty acids (SCFA), such as formate, actetate, isobutyrate, propionate isovalerate and valerate, have beneficial effect on the metabolism and immunity of their host.

The present invention thus further relates to a method for increasing the production of SCFA in the gut of a subject, comprising administering to the subject at least one bacterium of the invention and/or a variant thereof and/or at least one fragment thereof.

The present invention also relates to a method for increasing the production of butyrate, isobutyrate, butyric acid and/or isobutyric acid in the gut of a subject, comprising administering to the subject at least one bacterium of the invention and/or a variant thereof and/or at least one fragment thereof.

The present invention relates to a method for increasing the production of acetate and/or acetic acid in the gut of a subject, comprising administering to the subject at least one bacterium of the invention and/or a variant thereof and/or at least one fragment thereof.

The present invention relates to a method for increasing the production of propionate, iso-propionate, propionic acid and/or iso-propionic acid in the gut of a subject, comprising administering to the subject at least one bacterium of the invention and/or a variant thereof and/or at least one fragment thereof.

The present invention relates to a method for deceasing the expression of genes involved in the inflammatory response in the adipose tissues, preferably brown and/or subcutaneous adipose tissues, of a subject, comprising administering to the subject at least one bacterium of the invention and/or a variant thereof and/or at least one fragment thereof.

The present invention relates to a method for deceasing the expression of genes involved in the inflammatory response in the adipose tissues, preferably brown and/or subcutaneous adipose tissues, of a subject, comprising administering to the subject at least one bacterium of the invention and/or a variant thereof and/or at least one fragment thereof.

The present invention relates to a method for deceasing the expression of genes involved in fibrosis in the adipose tissues, preferably brown and/or subcutaneous adipose tissues, of a subject, comprising administering to the subject at least one bacterium of the invention and/or a variant thereof and/or at least one fragment thereof.

The present invention relates to a method for increasing the activation of the Toll-like receptor 2 (TLR2) receptor in the intestine of a subject, comprising administering to the subject at least one bacterium of the invention and/or a variant thereof and/or at least one fragment thereof. In one embodiment, the bacterium of the invention and/or a variant thereof and/or fragments thereof increases the activation of the Toll-like receptor 2 (TLR2) receptor in the intestinal epithelial cells of a subject.

The present invention relates to a method for increasing the production of valerate, isovalerate, valeric acid and/or isovaleric acid in the gut of a subject, comprising administering to the subject at least one bacterium of the invention and/or a variant thereof and/or at least one fragment thereof.

In one embodiment, the therapeutic methods of the invention comprise administering the composition, pharmaceutical composition or medicament of the invention to the subject. In one embodiment, a therapeutically effective amount of the at least one bacterium of the invention and/or a variant thereof and/or at least one fragment thereof is administered to the subject.

In one embodiment, the non-therapeutic methods of the invention comprise administering the composition, nutraceutical composition or cosmetic composition of the invention to the subject. In one embodiment, a cosmetically or nutraceutically effective amount of the at least one bacterium of the invention and/or a variant thereof and/or at least one fragment thereof is administered to the subject.

EXAMPLES

The present invention is further illustrated by the following examples.

Example 1: Isolation of Strain J115 from a Faecal Sample of a Healthy 25 Years Old Female For determining that an isolate is a new species, several analyses should be performed: morphological (such as motility and flagella), biochemical (such as enzymatic and fermentation capacity), physiological (such as fatty acid analysis) and phylogenetic (such as Average nucleotide identity (ANI), DNA-DNA hybridization and GC content) characterization.

Fecal sample was kept in a sealed container with an $O_2$-absorbing and $CO_2$-generating agent (Genbox Anaer; Biomérieux) and isolation was performed less than two hours after collection. The sample was transferred into an anaerobic chamber (Coy) containing 100% $N_2$ as gas atmosphere and immediately diluted 1/10 in modified YCFA (Yeast extract—casein hydrolysate—fatty acids) enriched in antioxidants (Table 1 and Table 2).

TABLE 1

Composition of the modified YCFA medium.

| Ingredient | Quantity for 1 L of medium |
| --- | --- |
| Yeast extract | 8 g |
| Soy peptone | 4 g |
| Wheat peptone | 4 g |
| KH2PO4 | 5 g |
| Na$_2$CO$_3$ | 4 g |
| NaCl | 1 g |
| MgCl$_2$ | 50 mg |
| MgSO$_4$ | 50 mg |
| CaCl$_2$ | 50 mg |
| Hemin | 10 mg |
| Resazurin solution (1 g/L) | 1 mL |
| Glucose | 10 g |
| Cystein | 1 g |
| Glutathion reduced | 1 g |
| Ascorbate | 0.5 g |
| Uric acid | 0.3 g |
| Vitamin solution | 1 mL |
| H$_2$O | q.s. 1000 mL | q.s.: quantum satis.

TABLE 2

Composition of the vitamin solution used to prepare the modified YCFA medium.

| Vitamins solution | Quantity for 1 L of solution (mg) |
| --- | --- |
| Biotin | 2 |
| Folic acid | 2 |
| Pyridoxine-HCl | 10 |
| Thiamine-HCl × 2 H | 2 |
| Riboflavin | 5 |
| Nicotinic acid | 5 |
| D-Ca-pantothenate | 5 |
| Vitamin B | 12 |
| p-Aminobenzoic acid | 5 |
| Lipoic acid | 5 |
| H$_2$O | q.s. 1000 | q.s.: quantum satis.

Fecal suspension was then transferred in tubes hermetically sealed with butyl rubber under an atmosphere of 20% $CO_2$-80% $N_2$. Then, single-cell cultivation was performed using extinction dilution technique, i.e., the fecal suspension was diluted and aliquoted in 300 vials such that a single vial received on average one cell. Positive cultures after 24 h to 7 days at 37° C. were spread onto solid modified YCFA and incubated 72 h to 7 days at the same temperature in anaerobic jars (Merck) with an $O_2$-absorbing and $CO_2$-generating agent (Genbox Anaer; Biomérieux). Single colonies were picked and transferred to fresh medium and the process was repeated until the cultures were deemed pure. Among the cultures obtained, one, designated J115, was considered for further study. Forty height hours cultures in modified YCFA medium were used for routine incubation, growth tests and biochemical analyses. The strain was stored at −80° C. in 20% glycerol.

The J115 strain was identified as related to species of the genus Oscillibacter, O. valericigenes and O. ruminantium (see section phylogenetic analysis hereinafter). Therefore, the type strains for each of these 2 species was obtained for comparison purpose. O. ruminantium JCM 18333$^T$ (=GH1T=KCTC 15176=NBRC 108824) was obtained from the Japan Collection of Microorganisms (JCM) while O. valericigenes DSM 18026$^T$ (Sjm18-20T=NBRC 101213) was obtained from the Deutsche Sarnmlung von Mikroorganismen and Zellkulturen (DSMZ). Forty-eight hours cultures in modified YCFA medium at 37° C. were used for routine incubation, growth tests and biochemical analyses. The strains were stored at −80° C. in 20% glycerol.

Scanning electron microscopy showed that J115 cells were straight rods, occurred singly and measured mainly 0.5-0.6×1.8-3.0 μm but rods up to 18-20 μm long were regularly observed during exponential and early stationary phase (FIG. 1). J115 colonies on solid modified YCFA after 72 h of incubation at 37° C. in anaerobic atmosphere were punctiform, cream, translucent, circular, entire, slightly convex and smooth. Strain was negative for motility when stab-inoculated into semi-solid modified YCFA (0.5% agar) and anaerobically incubated at 37° C. for 72 h. Contrary to J115 cells, O. valericigenes DSM 18026$^T$ and O. Ruminantium JCM 18333$^T$ cells are motile and have a flagellum.

The ability to tolerate bile and NaCl was tested in liquid modified YCFA containing increasing concentration of bovine bile (Sigma, 1% w/v of dehydrated bile corresponding to 10% w/v fresh bile) or NaCl (VWR). Growth of the strain occurred on medium containing below 2% bile or 2% NaCl but not on medium containing 2.5% or on medium containing 2.25% or above bile or NaCl. O. ruminantium JCM 18333$^T$ could grow on medium having 0 to 2% bile while O. valericigenes DSM 18026$^T$ could grow in medium containing 0 to 1% bile.

Gram staining was negative. KOH test (3%, w/v) was positive. No spore formation was observed in transmission or scanning electron microscopy (Philips Electron Microscope CM12/STEM) at exponential and stationary growing phase. No growth occurred after a 30 min treatment with 70° ethanol. No catalase was detected using 3% w/v $H_2O_2$ test for isolate J115 and the strain grew only in strict anaerobic conditions.

Biochemical Characterization

The results of biochemical characterization are given in the species description, Table 3 and Table 4. The rapid ID 32A anaerobe identification kit (Biomérieux) was used according to the manufacturer instruction and the API 20A anaerobe test kit and the API 50CH carbohydrates kit (Biomérieux) with modified YCFA without carbon source. Tests were performed in triplicate on three separate cultures. Rapid ID 32A and API 20A showed that strain J115 was positive for glutamic acid decarboxylase and arginine dihydrolase but negative for all the other tests (Table 3).

TABLE 3 biochemical characterization of strain J115, O. valericigenes DSM 18026$^T$ and O. Ruminantium JCM 18333$^T$. Results from Rapid ID32A and API 20A tests are indicated as follow "−" indicates a negative test, "+" indicates a positive test.

| Enzymatic activity | J115 | DSM 18026$^T$ | JCM 18333$^T$ |
|---|---|---|---|
| Indole production | − | − | − |
| Nitrates reduction | − | − | − |
| Gelatinase | − | − | − |
| Esculinase | − | − | + |
| Urease | − | − | − |
| Alkaline phosphatase | − | − | − |
| Arginine dihydrolase | + | + | + |
| α-galactosidase | − | − | − |
| β-galactosidase | − | − | − |
| β-galactosidase-6-phosphate | − | − | − |
| α-glucosidase | − | − | − |
| β-glucosidase | − | − | − |
| α-arabinosidase | − | − | − |
| β-glucuronidase | − | − | − |
| N-acetyl-β-glucosaminidase | − | − | − |
| α-fucosidase | − | − | − |
| Glutamic acid decarboxylase | + | + | + |
| Arginine arylamidase | − | − | − |
| Proline arylamidase | − | − | − |
| Leucyl glycine arylamidase | − | − | − |
| Phenylalanine arylamidase | − | − | − |
| Leucine arylamidase | − | − | − |
| Pyroglutamic acid arylamidase | − | − | − |
| Tyrosine arylamidase | − | − | − |
| Alanine arylamidase | − | − | − |
| Glycine arylamidase | − | − | − |
| Histidine arylamidase | − | − | − |
| Glutamyl glutamic acid arylamidase | − | − | − |
| Serine arylamidase | − | − | − |

Acid production by fermentation from various carbon sources was tested using API 50CH kit and is was found that strain J115 could be differentiated from both Oscillibacter species by its ability to ferment myo-inositol and its inability to ferment D-glucose, and D-xylose (Table 4).

TABLE 4 fermentation capacity of strain J115. na: not available. Results from the API 50 CH test are presented as follow: "−" indicates a substrate not fermented by the strain considered and "+" indicates a substrate fermented by the strain considered

| | J115 | O. valerecigenes DSM 18026$^T$ | O. ruminantium JCM 18333$^T$ |
|---|---|---|---|
| Glycerol | − | − | − |
| Erythritol | − | − | − |
| D-arabinose | − | − | − |
| L-arabinose | − | − | + |
| D-ribose | − | − | + |
| D-xylose | − | + | + |
| L-xylose | − | − | − |
| D-adonytol | − | − | − |
| Methyl-βD-xylopyranoside | − | − | − |
| D-galactose | − | − | − |
| D-glucose | − | + | + |
| D-fructose | − | − | − |
| D-mannose | − | − | − |
| L-sorbose | − | − | − |
| L-rhamnose | − | − | − |
| Dulcitol | − | − | − |
| Myo-inositol | + | − | − |
| D-mannitol | − | − | − |
| D-sorbitol | − | − | − |
| Methyl-αD-mannopyranoside | − | − | − |
| Methyl-αD-glucopyranoside | − | − | − |
| N-acetyl-glucosamine | − | − | − |
| Amygdaline | − | − | − |
| Arbutine | − | − | − |
| Salicin | − | − | − |
| D-cellobiose | − | − | − |
| D-maltose | − | − | − |
| D-lactose | − | − | − |
| D-melibiose | − | − | − |
| Sucrose | − | − | − |
| D-trehalose | − | − | − |
| Inulin | − | − | − |
| D-melezitol | − | − | + |
| D-raffinose | − | − | − |
| Starch | − | − | − |
| Glycogen | − | − | − |
| Xylitol | − | − | − |
| Gentibiose | − | − | − |
| D-turanose | − | − | − |
| D-lyxose | − | − | − |
| L-lyxose | − | − | − |
| D-tagatose | − | + | − |
| D-fucose | − | − | − |
| L-fucose | − | − | − |
| D-arabitol | − | − | − |
| L-arabitol | − | − | − |
| Potassium gluconate | − | − | − |
| Potassium 2-cetogluconate | − | − | − |
| Potassium 5-cetogluconate | − | − | − |

Cellular Fatty Acid Composition

Cellular fatty acids were analyzed by the Identification Service of the DSMZ, Braunschweig, Germany from 30 mg of freeze-dried cells by saponification, methylation and extraction using minor modifications of the method of Miller (J Clin Microbiol. 1982 September; 16(3):584-6) and Kuykendall et al. (Int J Syst Evol Microbiol. 1988; 38(4):358-361). As O. valericigenes Sjm18-20T and O. ruminantium GH1T, the major cellular saturated branched-chain fatty acids of strain J115 are iso-C15:0 (24.2%) and anteiso-C15:0 (15.2%) (Table 5). However, the quantities differed quite substantially as iso-$C_{15:0}$ represented only 9.8 and 8.9% of the cellular fatty acids in the Oscillibacter species. Furthermore, anteiso-$C_{15:0}$ are not major cellular fatty acids of O. valericigenes DSM 18026$^T$ and O. ruminantium JCM 18333$^T$. Conversely, the saturated straight fatty acids $C_{14:0}$ and $C_{16:0}$ are major cellular fatty acids of O. valericigenes DSM 18026$^T$ and *O. ruminantium* JCM 18333$^T$ but are detected only in trace amount in strain J115.

TABLE 5

Cellular fatty acids analysis. Strains: 1, J115; 2, *O. valericigenes* Sjm 18-20T; 3, *O. ruminantium* GH1T.

| Fatty acid | 1 | 2 | 3 |
|---|---|---|---|
| Saturated straight-chain | | | |
| $C_{12:0}$ | Tr | 1.2 | 5.3 |
| $C_{14:0}$ | 2.4 | 14.7 | 11.5 |
| $C_{15:0}$ | Tr | 1.7 | Tr |
| $C_{16:0}$ | Tr | 8.7 | 14.3 |
| $C_{18:0}$ | Tr | Tr | 1.7 |
| Unsaturated straight-chain | | | |
| C18:2ω6,9c | Tr | Tr | Tr |
| Dimethylacetal (DMA) | | | |
| $C_{14:0}$ DMA | Tr | 6.5 | 4.5 |
| anteiso-$C_{15:0}$ DMA | 1.0 | Tr | Tr |
| $C_{16:0}$ DMA | 7.6 | 25.2 | 19.9 |
| $C_{17:0}$ DMA | 2.2 | Tr | Tr |
| $C_{18:0}$ DMA | 18.4 | — | — |
| Aldehydes | | | |
| $C_{16:0}$ ALDE | 1.1 | 3.8 | 4.3 |
| $C_{18:0}$ ALDE | 4.3 | — | — |
| Saturated branched-chain | | | |
| iso-$C_{13:0}$ | Tr | 1.3 | 11.8 |
| iso-$C_{14:0}$ | 1.5 | Tr | Tr |
| iso-$C_{15:0}$ | 24.2 | 9.8 | 8.3 |
| iso-$C_{16:0}$ | Tr | — | — |
| anteiso-$C_{13:0}$ | Tr | Tr | 1.2 |
| anteiso-$C_{15:0}$ | 15.2 | 3.0 | 3.0 |
| iso-$C_{17:0}$ | Tr | — | — |
| anteiso-$C_{17:0}$ | Tr | — | — |
| Summed features* | | | |
| 1 | Tr | 1.0 | Tr |
| 3 | Tr | Tr | Tr |
| 5 | Tr | Tr | 1.9 |

Tr, trace amount (<1%);
—, not detected.
*Summed features represent groups of two or three fatty acids that could not be separated using the MIDI Sherlock system. Summed feature 1 contains $C_{13:1}$ω1c and/or $C_{14:0}$ ALDE. Summed feature 3 contains one or more of an unknown fatty acid of ECL 13.570 and/or iso-$C_{15:0}$ ALDE. Summed feature 5 contains $C_{15:0}$ DMA and/or $C_{14:0}$ 3-OH.

However, strain J115 differs from those two species by the fatty aldehydes found as dimethylacetals (DMAs) such as $C_{18:0}$ DMA which is abundant in J115 (18.4%) but absent from *Oscillibacter* species. Moreover, $C_{16:0}$ DMA are found in much lower concentrations in strain J115 than in *Oscillibacter* species. $C_{16:0}$ DMA represented 25.2 and 19.9% of the cellular fatty acids in the two *Oscillibacter* species. In addition, $C_{14:0}$ DMA is detected in appreciable amount in *O. valericigenes* DSM 18026$^T$ and *O. ruminantium* JCM 18333$^T$ (6.2 and 4.5%, respectively) but represents only trace amount of the cellular fatty acids of strain J115.

Respiratory Lipoquinones

Respiratory lipoquinones and diaminopimelic acid of strain J115 were analyzed by the Identification Service of the DSMZ, Braunschweig, Germany. Briefly, quinones were extracted from 100 mg of freeze dried cells using methanol:hexane, followed by phase separation into hexane according to Tindall's method. As in *Oscillibacter* species, no quinone was detected in strain J115. Whole cell hydrolysates were examined by thin layer chromatography on cellulose plates using the solvent system of Rhuland et al. (J Am Chem Soc 1955; 77:4844-6). Strain J115 contained meso-2,6-diaminopimelic acid as the diagnostic diamino acid of the cell-wall peptidoglycan.

Analysis of DNA base composition was carried out by the Identification Service and Dr Peter Schumann, DSMZ, Braunschweig, Germany. The DNA GC content of strain J115 was 59.3%, slightly higher of those of those of *O. valericigenes* Sjm18-20T and *O. ruminantium* GH1T (52.9% and 54.9% respectively).

Phylogenic Analyses

An almost complete (1428 bp-SEQ ID NO: 1) 16S rRNA sequence of strain J115 was obtained using the universal primers 8F (5'-AGAGTTTGATCCTGGCTCAG-3' SEQ ID NO: 2) and 1492R (5'-GGTTACCTTGTTACGACTT-3' SEQ ID NO: 3). 16S rRNA sequences of the closest previously identified relatives of strain J115 were determined and retrieved using EzBioCloud's Identify service (database updated 2017 Oct. 23) and GenBank database®.

Figure 2A:
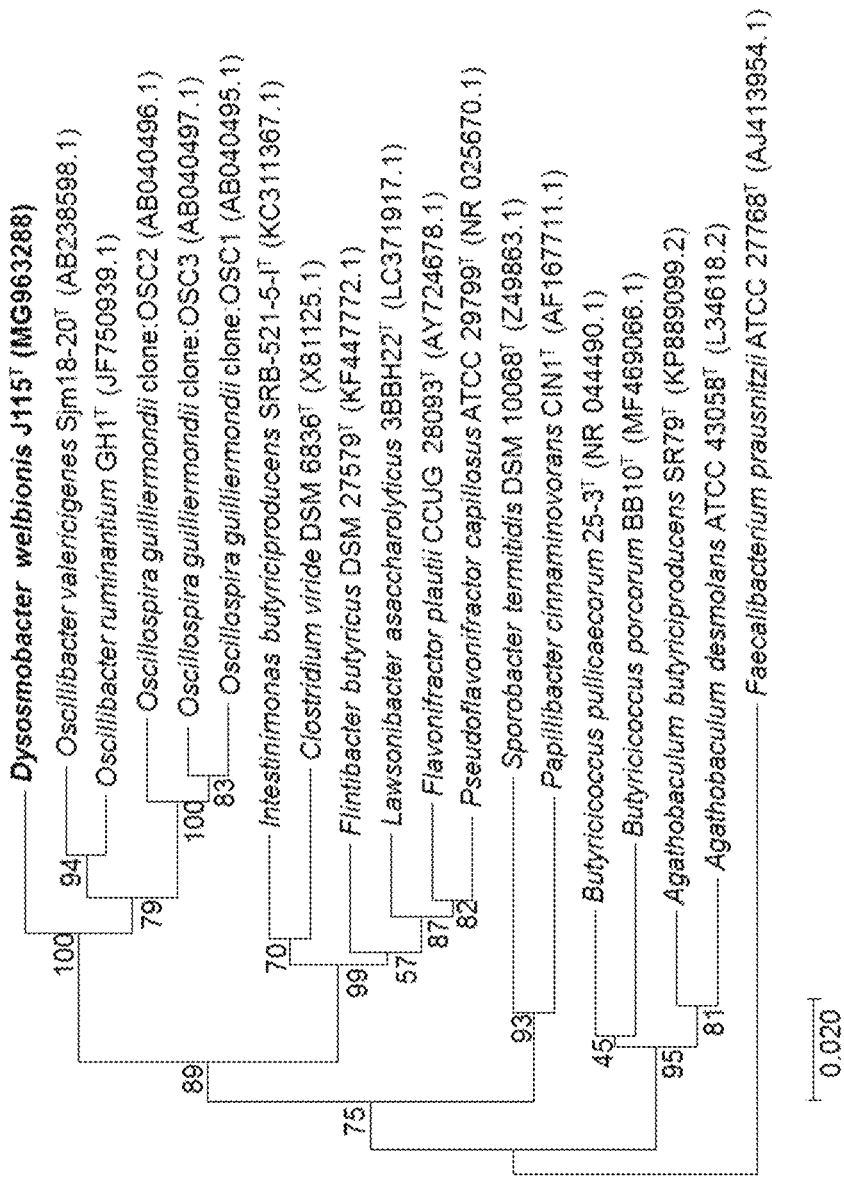
FIGS. 2A and 2B show phylogenetic trees based on 16S rRNA gene sequences, showing the connections between strain J115 (*Dysosmobacter welbionis*), *Oscillibacter. ruminantium* JCM 18333$^T$ (=GH1T=KCTC 15176=NBRC 108824) *Oscillibacter valericigenes* DSM 18026$^T$ (Sjm18-20T=NBRC 101213), *Oscillospira guilliermondii* clones and other related taxa. GenBank accession numbers are shown in parentheses. Bootstrap values based on 1000 replicates are indicated on branch points. Bars, 0.02 substitutions per nucleotide position. (A) Neighbor-joining phylogenetic tree, (B) Maximum-likelihood phylogenetic tree.
Figure 2B:
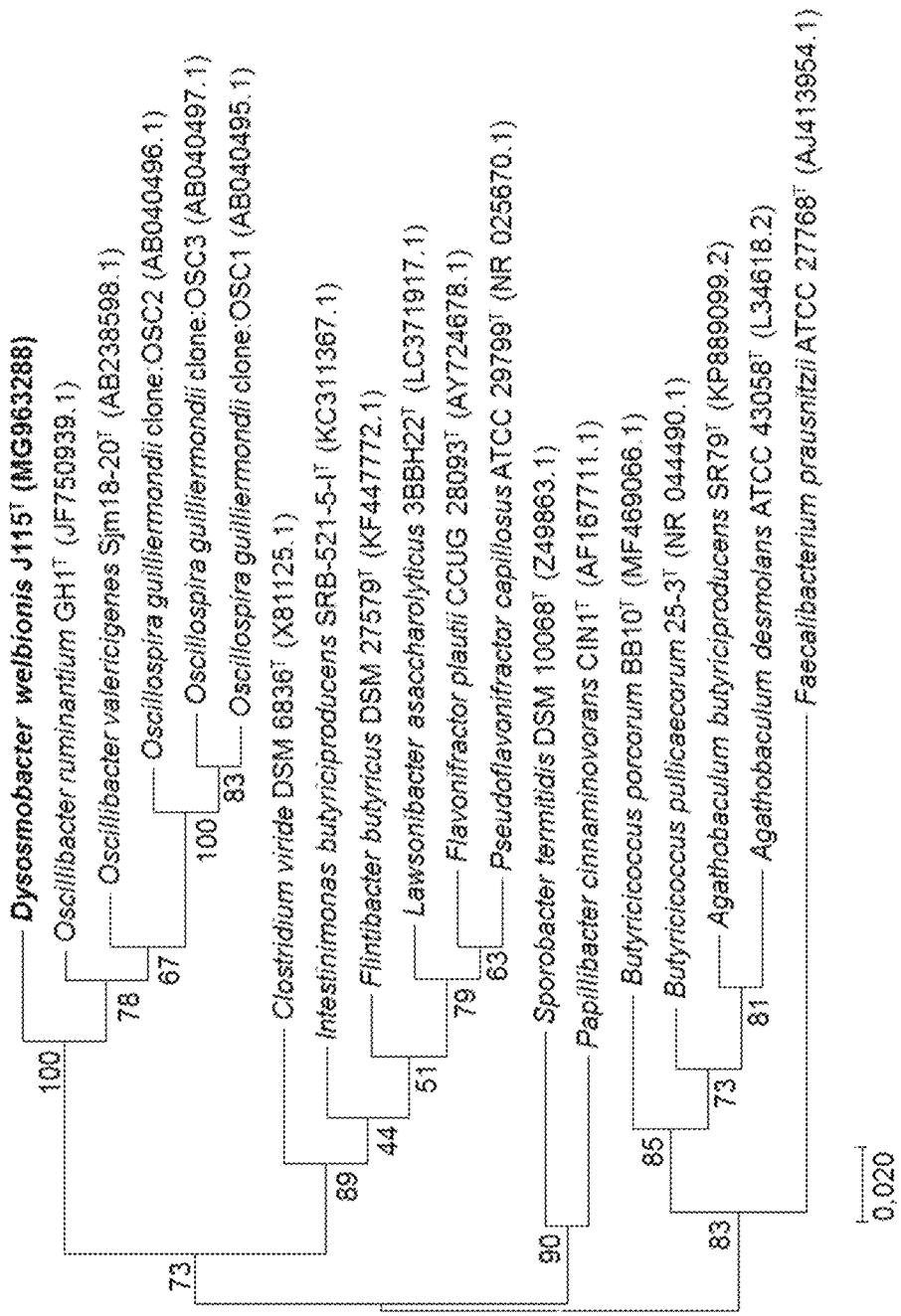

Multiple alignment of the sequences was performed using MUSCLE. Distances were computed using the Maximum Composite Likelihood method and the phylogenetic tree was constructed by the neighbor joining method in MEGA 7.0 after gaps and unknown bases were eliminated. Strain J115 falls within cluster IV of the low GC content clostridial bacteria branch. Strain J115 was related to *Oscillibacter ruminantium* GH1T (95.4% similarity) and *Oscillibacter valericigenes* Sjm 18-20T (94.1% similarity). Strain J115 was also located near the *Oscillospira guilliermondii* clade. Phylogenetically, strain J115$^T$ formed a monophyletic separate branch that was located as a sister clade to the *Oscillibacter-Oscillospira* clade supported by a 100% bootstrap value in both neighbor-joining and maximum likelihood trees (FIGS. 2A and B).

For whole genome sequence, high molecular weight DNA was extracted using Qiagen DNeasy UltraClean Microbial kit. Long-reads were obtained using PacBio technology at Eurofins GATC company. Assembly was performed using hierarchical genome-assembly process and produced a 3 576 111 base pairs complete genome in one contig [NCBI accession number CP034413], whose depth of coverage was 242. Genome analysis using ContEst16S algorithm indicated that the genome of strain J115$^T$ was not contaminated. The sequences of three 16S rRNA gene copies were retrieved and compared to the 16S rRNA gene sequence obtained by PCR and Sanger sequencing. The three copies were strictly identical to the sequence obtained by PCR.

Figure 3A:
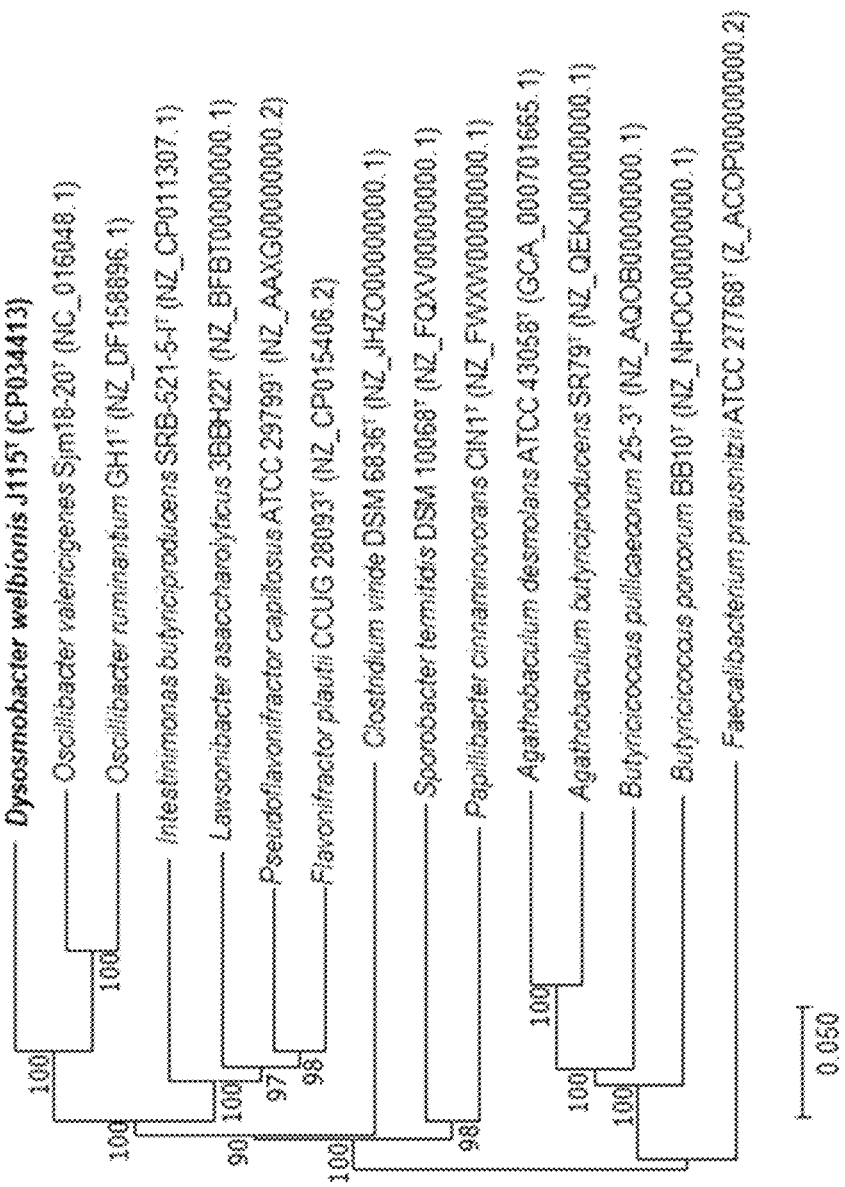
FIGS. 3A and 3B show phylogenetic trees of the MLSA based on the concatenated sequences of twelve protein-coding genes, showing the connections between strain J115 (*Dysosmobacter welbionis*), *Oscillibacter. ruminantium* JCM 18333$^T$ (=GH1T=KCTC 15176=NBRC 108824) *Oscillibacter valericigenes* DSM 18026$^T$ (Sjm18-20$^T$=NBRC 101213) and other related taxa. GenBank accession numbers of the complete genomes used to retrieve the genes sequences are shown in parentheses. Bootstrap values based on 1000 replicates are indicated on branch points. The twelve genes included in the MLSA are RNA polymerase sporulation specific sigma factor SigE (sigE), phosphoribosylformylglycinamidine cyclo-ligase (purM), argininosuccinate synthase (ass), aspartokinase (lysC), phosphate starvation-inducible protein (phoH), catabolite repression HPr-like protein (crh), chaperone groEL (groEL), tRNA modification GTPase MnmE (thdF), translation initiation factor IF-2 (infB), protein recA (recA), RNA polymerase sigma factor RpoD (rpoD) and DNA gyrase subunit B (gyrB). Bars, 0.05 substitutions per nucleotide position. (A) Neighbor-joining phylogenetic tree, (B) Maximum-likelihood phylogenetic tree.
Figure 3B:
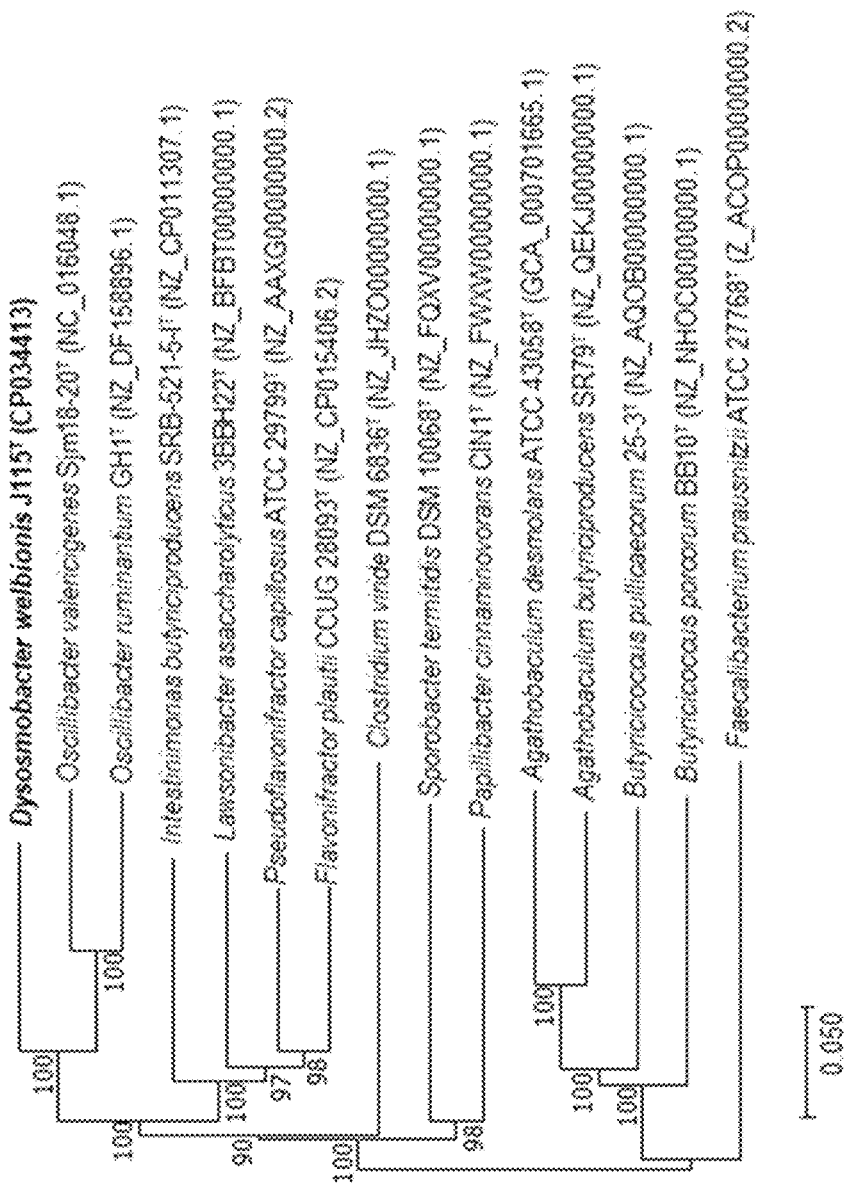

Multilocus sequence analysis (MLSA) was performed to obtain a higher resolution of the phylogenetic relationships between strain J115 and neighbour taxa belonging to the Ruminococcaceae family. The sequences of 12 protein-coding genes (sigE, purM, ass, lysC, phoH, crh, groEL, thdF, in/B, recA, rpoD and gyrB) were retrieved from the complete genomes of all type strains except from Oscillispira guilliermondii and Flintibacter butyricus whose complete genomes are not available. Similarly, to the 16S rRNA gene analysis, the concatenated sequences were aligned using MUSCLE and phylogenetic trees were constructed by the neighbor-joining and maximum likelihood methods with 1000 bootstraps replications (FIGS. 3A and B). As previously, J115 formed a monophyletic separate branch that was located as a sister clade to the *Oscillibacter* clade supported by a 100% bootstrap value in both trees.

Figure 4:
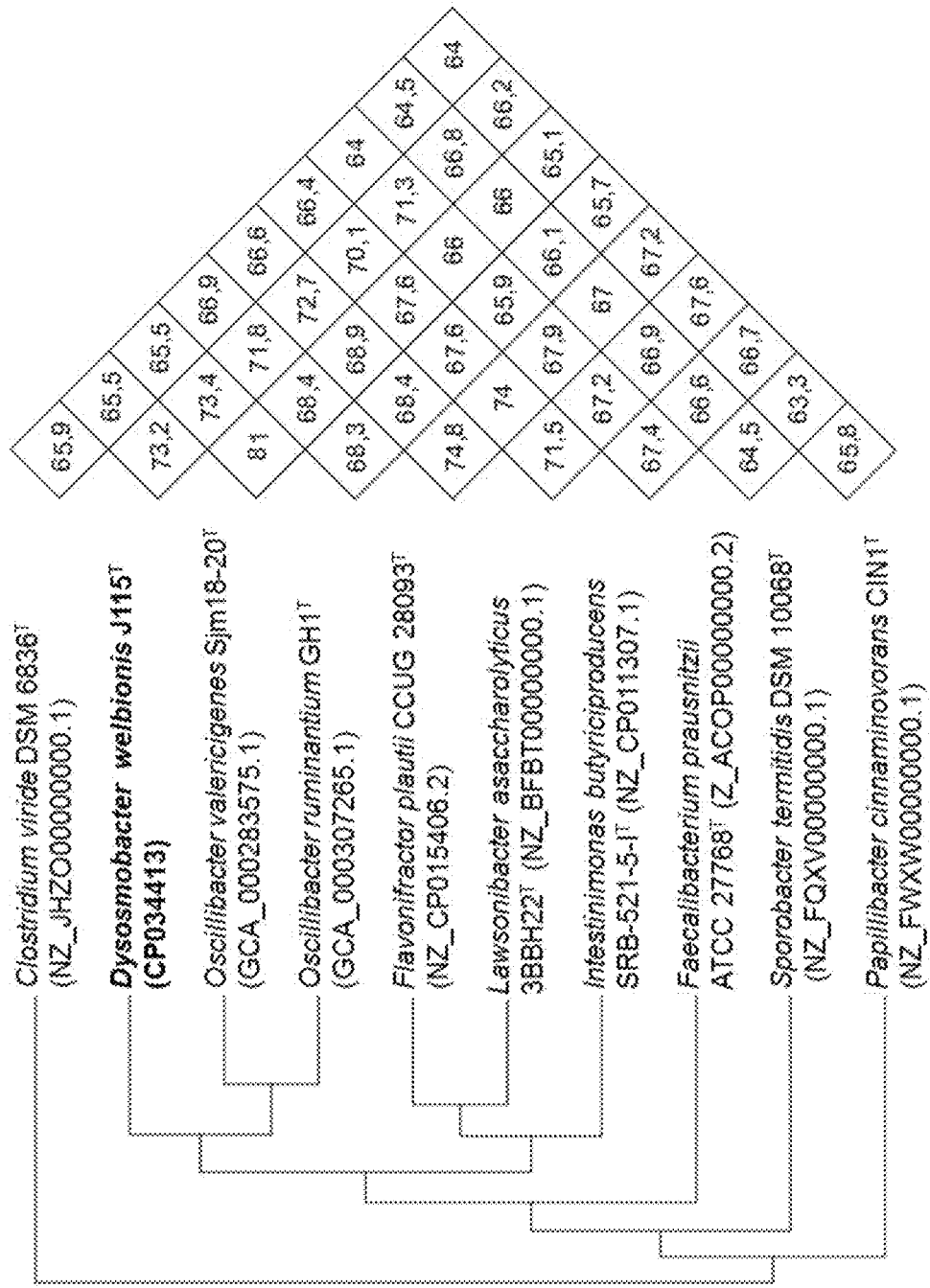
FIG. 4 shows an unweighted pair group method with arithmetic mean (UPGMA) phylogenetic tree of the average nucleotide identity (ANI) based on the whole genomes, showing the connections between strain J115 (*Dysosmobacter welbionis*), *Oscillibacter. ruminantium* JCM 18333$^T$ (=GH1T=KCTC 15176=NBRC 108824) *Oscillibacter valericigenes* DSM 18026$^1$ (Sjm18-20$^T$=NBRC 101213) and other related taxa. GenBank accession numbers of the complete genomes used are shown in parentheses.

A robust measurement of genomic relatedness between strain, the Average nucleotide identity (ANI), strain J115 and available reference strains genomes were calculated using OAT standalone 0.93.1 software. The ANI scores were represented as a heatmap and used to construct a dendrogram with unweighted pair group method with arithmetic mean (UPGMA) (FIG. 4). An ANI score obtained with reference species or strain that is higher than 98.65% (or 98.7%) implies that the isolate is a new species. As in 16S rRNA gene sequence and MLSA, the closest taxa to strain J115" were *O. ruminantium* JCM 18333$^T$ and *O. valericigenes* DSM 18026$^T$ with ANI scores of 73.37 and 73.24, respectively.

Figure 5:
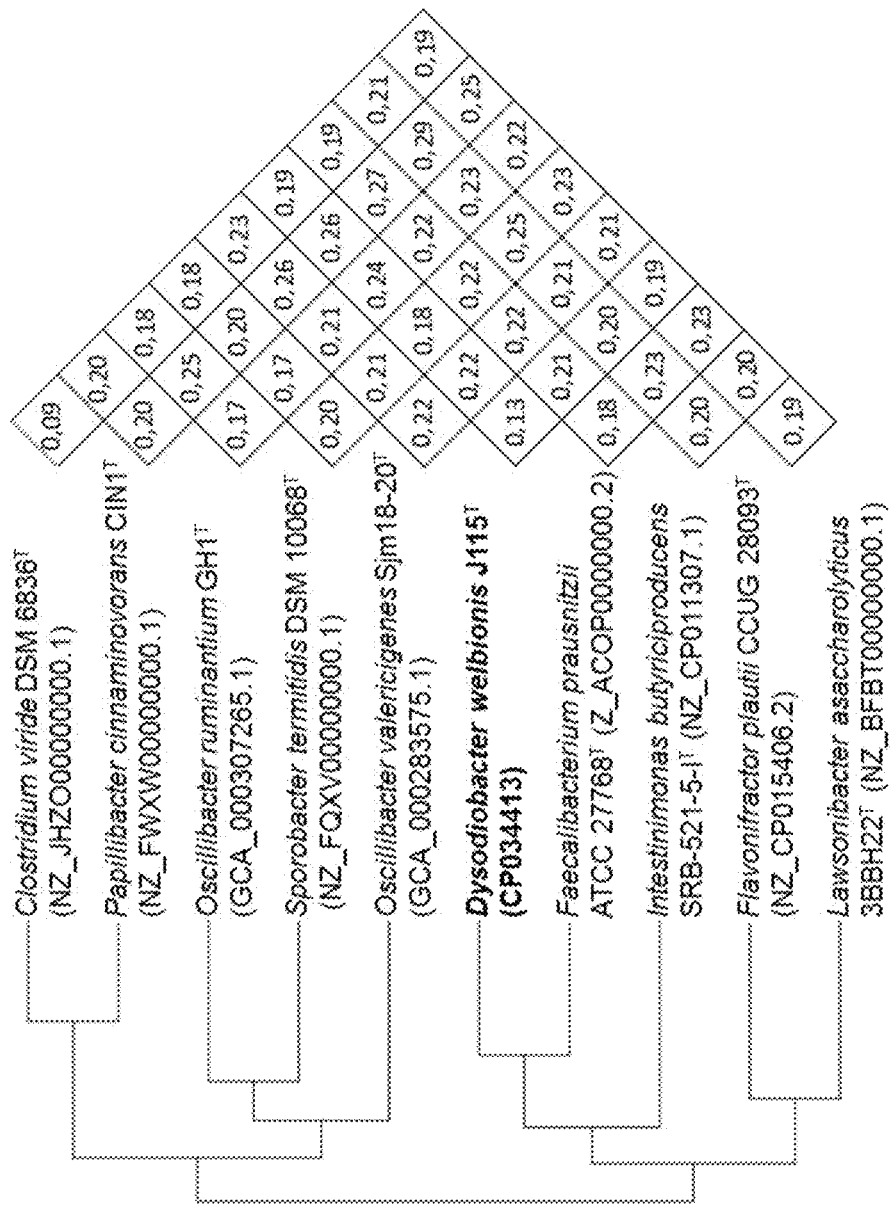
FIG. 5 shows an UPGMA phylogenetic tree of the intergenome distances (GGD) based on the whole genomes, showing the connections between strain J115 (*Dysosmobacter welbionis*), *Oscillibacter ruminantium* JCM 18333$^T$ (=GH1T=KCTC 15176=NBRC 108824) *Oscillibacter valericigenes* DSM 18026$^T$ (Sjm18-20$^T$=NBRC 101213) and other related taxa. GenBank accession numbers of the complete genomes used are shown in parentheses.

To complement this analysis based on ANI, intergenome distance was calculated using the genome to genome calculator 2.1 provided by DSMZ. The settings used were BLAST+ as local alignment tool and formula 2, that is to say the sum of all identities found in high-scoring segment pairs (HSP) divided by overall HSP length. Intergenome distances were then used to determine the probability to have a DNA-DNA hybridization (DDH) equal or above 70% and to generate a heatmap along with a UPGMA tree using OAT standalone 0.93.1 software (FIG. 5). The UPGMA tree based on intergenome distances had a quite different topology from the previously obtained trees. Indeed, the closest species with standing in Nomenclature according to intergenome distance was *Faecalibacterium prausnitzii* ATCC 27768$^T$ with an intergenome distance of 0.1342 which corresponds to a probability of DDH equal or above 70% of 0.19 and an in silico DDH value of 31.5 [29.1-34]%. Despite the divergences to the 16S rRNA gene sequence, MLSA and ANI based results, in silico DDH results clearly indicate that strain J115 belongs to the Ruminococcaceae family in Clostridial cluster IV and differs significantly from the closest taxon with standing in Nomenclature: the *Oscillibacter* genus.

Conclusion

Table 6 summarizes the differences observed between strain J115 and the type strains of the closest related species *Oscillibacter. ruminantium* JCM 18333$^T$ (=GH1T=KCTC 15176=NBRC 108824) *Oscillibacter valericigenes* DSM 18026$^T$ (Sjm18-20T=NBRC 101213).

TABLE 6

Characteristics of strain J115 (*Dysosmobacter welbionis*), *O. valericigenes* DSM 18026$^T$ and *O. ruminantium* JCM 18333$^T$

| Characteristic | 1 | 2 | 3 |
|---|---|---|---|
| Source of isolation | Human gut | Alimentary canal of Japanese corbicula clams | rumen of Korean native cattle |
| Motility | Non-motile | Motile | Motile |
| Flagella | Absent | Present | Present |
| GC content (mol %) by HPLC | 59.3 | 52.7 | 54.6 |
| GC content (mol %) based on genome data | 58.9 | 53.2 | 55.0 |
| Growth bile concentration range | 0-2% | 0-1% | 0-2% |
| Growth NaCl concentration range | 0-1.4% | 0-3.5% | 0-2.5% |
| Fermentation capacity | | | |
| myo-inositol | + | − | − |
| D-xylose | − | + | + |
| D-arabinose | − | − | + |
| D-ribose | − | − | + |
| D-glucose | − | + | + |
| D-melezitol | − | − | + |
| Tagatose | − | + | − |
| Enzymatic activity | | | |
| Aesculinase | + | − | + |
| Sequence-based analyses | | | |
| 16S mRNA identity with J115 | | 94.1% | 95.4% |
| Average Nucleotide Identity (ANI) with J115 | | 73.24 | 73.37 |
| Intergenome distance with J115 | | 0.22 | 0.24 |

Strain J115 16S rRNA gene sequence diverges from those of *O. ruminantium* GH1T and *O. valericigenes* Sjm 18-20T by 4.6-5.9%, which is lower than the proposed threshold of 6% for prokaryotic genus delineation. Cells of strain J115 were straight rods, normally 1.8-3.0 μm and often form elongated rods. Strain J115 was strictly anaerobic and had no respiratory quinone. These properties are similar to those of *Oscillibacter* species. However, strain J115 was non-motile, had no flagella and had different cellular fatty acids composition. In addition, strain J115 was not able to utilize glucose, and xylose on the contrary to species belonging to *Oscillibacter* genus but was able to ferment myo-inositol. Phylogenetically, strain J115 formed a separate branch to the clade *Oscillibacter-Oscillospira*. These two subclades are already accommodated as two separate genera. On the basis of its phylogenetic position and biochemical and physiological properties described above, strain J115 differs significantly from the nearest cultivated genus members, namely *Oscillibacter ruminantium* and *Oscillibacter valericigenes*. Consequently, strain J115 represents a novel species of a new genus, for which the name *Dysosmobacter welbionis* gen. nov. sp. nov. is proposed.

Example 2: Description of *Dysosmobacter* Gen. Nov

*Dysosmobacter* cells are obligatory anaerobic, non-pigmented, non-spore-forming, non-motile, Gram-stain-negative. Cells form straight rods mainly 1.8-3.0 μm but often form elongated rods whatever the growing phase. No respiratory menaquinones are produced. The diagnostic diamino acid in the cell wall is meso-2,6-diaminopimelic acid. The genus is a member of the family Ruminococcaceae. The type species is *Dysosmobacter welbionis*.

Example 3: Description of *Dysosmobacter Welbionis* Sp. Nov

*Dysosmobacter welbionis* exhibits the following characteristics in addition to those in the genus description. Colonies on solid modified YCFA after 72 h of incubation at 37° C. under anaerobic conditions are punctiform, cream, translucent, circular, entire, slightly convex and smooth. Growth is inhibited by the presence of 2% bile or 2% NaCl. Aesculin is not hydrolysed. Indole is not produced. Nitrate is not reduced. Gelatin is not digested. Urease is not produced. Catalase is not produced. Acid is produced from myo-inositol but not from D-glucose, D-arabinose, D-ribose and D-xylose. Positive reactions are obtained for arginine dihydrolase and glutamic acid decarboxylase. All the other tests from API 20A and Rapid ID 32A are negative (i.e. alkaline phosphatase, α-galactosidase, β-galactosidase, α-glucosidase, β-glucosidase, α-arabinosidase, β-glucuronidase, N-acctylglucosaminidase, α-fucosidase, arginine arylamidase, proline arylamidase, leucyl-glycine arylamidase, phenylalanine arylamidase, pyroglutamic acid arylamidase, tyrosine arylamidase, alanine arylamidase, glycine arylamydase, histidine arylamidase, serine arylamidase). Acid is produced from myo-inositol but not from D-adonytol, amygdaline, D/L-arabinose, D/L-arabitol, arbutine, D-cellobiose, dulcitol, erythrol, D-fructose, D/L-fucose, D-galactose, gentibiose, D-glucose, glycerol, glycogen, inulin, D-lactose, lyxose, D-maltose, D-mannitol, D-mannose, D-melezitol, D-mellibiose, methyl-αD-glucopyranoside, methyl-αD-mannopyranoside, methyl-βD-xylanopyranoside, N-acethylglucosamine, D-raffinose, L-rhamnose, D-ribose, D-saccharose, salicin, D-sorbitol, L-sorbose, starch, tagatose, D-trehalose, D-turanose, xylitol and D/L-xylose). Major fermentation end-products from myo-inositol are butyrate (or butyric acid). The DNA GC content of the type strain is 58.92 mol %. Major cellular fatty acids are saturated branched-chain fatty acids and DMAs. Major DMA fatty acid is $C_{18:0}$ DMA and major saturated branched-chain fatty acids are iso-$C_{15:0}$ and anteiso-$C_{15:0}$. The species type strain is, J115 (deposited at the BCCM/LMG on Mar. 14, 2018 as LMG P-30603) was isolated from human feces. Strain J115 is hence also referred to herein as strain $3115^T$.

Example 4: Modification to the Description of Related Taxa

Observations made during the comparison of the characteristics of 3115 with the characteristics of the type strains of the related species, *Oscillibacter valericigenes* and *Oscillibacter ruminantium* lead to a necessary update to the previously published description of the related genera *Oscillibacter* and of the related species *Oscillibacter valericigenes* and *Oscillibacter ruminantium*.

Emended Description of the Genus *Oscillibacter*

The description is as given by Iino et al. (Int J Syst Evol Microbiol 2007; 57:1840-5) with the following modifications. Positive for glutamic acid decarboxylase and arginine dihydrolase. Negative for alkaline phosphatase, a-galactosidase, β-galactosidase, α-glucosidase, 13-glucosidase, α-arabinosidase, β-glucuronidase, N-acetylglucosaminidase, α-fucosidase, arginine arylamidase, proline arylamidase, leucyl-glycine arylamidase, phenylalanine arylamidase, pyroglutamic acid arylamidase, tyrosine arylamidase, alanine arylamidase, glycine arylamydase, histidine arylamidase, serine arylamidase. Indole is not produced from tryptophane. Gelatin is not digested.

Emended description of *Oscillibacter valericigenes*

The description is as given by Iino et al. (Int J Syst Evol Microbiol 2007; 57:1840-5) with the following modifications. Aesculin is not hydrolysed. The bile concentration range allowing growth is 0-1%. Acid is produced from tagatose. Acid is not produced from D/L-arabinose and D-ribose.

Emended Description of *Oscillibacter ruminantium*

The description is as given by Lee et al. (Int J Syst Evol Microbiol 2013; 63:1942-6) with the following modifications. Acsculin is hydrolysed. The bile concentration range allowing growth is 0-2%. Acid is produced from D-arabinose and D-melezitol.

Example 5: Effects of the Administration of *Dysosmobacter Welbionis* on Metabolism, Feeding Behaviour and Intestinal Barrier Material and Methods
Mice A set of 10-week-old C57BL/6J mice (30 mice, n=10/group) (Janvier Labs, France) were housed in groups of 2 mice/cage, with free access to food and water. The mice were fed a control diet (CT) (AIN93Mi; Research diet, New Brunswick, N.J., USA) or a high-fat diet (HFD) (60% fat and 20% carbohydrates (kcal/100 g), D12492, Research diet, New Brunswick, N.J., USA). Mice were treated with an oral administration of *Dysosmobacter welbionis* by oral gavage at the dose $1·10^9$ cfu/0.2 mL suspended in sterile anaerobic phosphate-carbonate buffer saline (HFD-*Dysosmobacter* J115) and control groups were treated with an oral gavage of an equivalent volume of sterile anaerobic phosphate-carbonate buffer saline (Control and HFD). Treatment continued for 8 weeks.

*D. welbionis* J115 (deposited at the BCCM/LMG on Mar. 14, 2018 as LMG P-30603) was grown anaerobically in a modified YCFA medium enriched in inositol as described in Example 1 and then washed and suspended in anaerobic phosphate-carbonate buffer saline to an end concentration of $1·10^9$ cfu/0.2 mL.

Food and water intake were recorded once a week. Body composition was assessed by using 7.5 MHz time domain-nuclear magnetic resonance (TD-NMR) (LF50 minispec, Bruker, Rheinstetten, Germany).

All mouse experiments were approved by and performed in accordance with the guidelines of the local ethics committee. Housing conditions were specified by the Belgian Law of Apr. 6, 2010, regarding the protection of laboratory animals (agreement number LA1230314).

*Dysosmobacter Welbionis* $J115^T$ Cultivation and Enumeration

*D. welbionis* $J115^1$ (LMG P-30603) was grown anaerobically in a modified YCFA medium enriched with inositol as previously described (Le Roy et al, published in Int J Syst Evol Microbiol, 2019, DOI 10.1099/ijsem.0.003547).

Tissue Sampling

The animals were anesthetized with isoflurane (Forene®, Abbott, Queenborough, Kent, England) before exsanguination and tissue sampling, then mice were killed by cervical dislocation. The intestinal segments (duodenum, jejunum, ileum, cecum and colon) were dissected, immersed in liquid nitrogen, and stored at −80° C., for further analysis.

RNA Preparation and Real-Time qPCR Analysis

Total RNA was prepared from tissues using TriPure reagent (Roche). Quantification and integrity analysis of total RNA was performed by running 1 μL of each sample on an Agilent 2100 Bioanalyzer (Agilent RNA 6000 Nano Kit, Agilent).

cDNA was prepared by reverse transcription of 1 μg total RNA using a Reverse Transcription System kit (Promega, Leiden, The Netherlands). Real-time PCRs were performed with the StepOnePlus™ real-time PCR system and software (Applied Biosystems, Den Ijssel, The Netherlands) using Mesa Fast gPCR™ (Eurogentec, Seraing, Belgium) for detection according to the manufacturer's instructions. RPL19 was chosen as the housekeeping gene. All samples were run in duplicate in a single 96-well reaction plate, and data were analyzed according to the $2^{-\Delta\Delta Ct}$ method. The identity and purity of the amplified product was checked through analysis of the melting curve carried out at the end of amplification. Primer sequences for the targeted mouse genes are presented in the Table 7 below.

TABLE 7

Nucleotide sequence of the primer pairs used for the measurement of mRNAs expression level by qPCR.

| Primers | | Sequence | SEQ ID NO: |
|---|---|---|---|
| RPL-19 | Forward | GAAGGTCAAAGGGAATGTGTTCA | 4 |
| | Reverse | CCTGTTGCTCACTTGT | 5 |
| Proglucagon | Forward | TGGCAGCACGCCCTTC | 6 |
| | Reverse | GCGCTTCTGTCTGGGA | 7 |
| Occludin | Forward | ATGTCCGGCCGATGCTCTC | 8 |
| | Reverse | TTTGGCTGCTCTTGGGTCTGTAT | 9 |

Intestinal Energy Absorption

Six weeks after the beginning of the experiment, the feces of two seven-days periods were collected. During the same time the food intake was monitored. The feces were dried at 60° C. during 2 hours and weighted. Total energy of the diet and the feces was determined by bomb calorimetry (C1, IKA, USA). The net intestinal absorption is calculated based on the ingested and excreted energy and represented the proportion of ingested energy that was not recovered in feces output.

Statistical Analysis

Data are expressed as means±s.e.m. Differences between groups were assessed by one-way ANOVA followed by pairwise comparisons and tested for false discovery rate using the two-stage step-up method of Benjamini, Krieger and Yekutieli. Correlations were assessed by Pearson or non-parametric Spearman tests depending on if the variables passed Shapiro-Wilk normality test or not. Data were analyzed using GraphPad Prism version 7.00 for windows (GraphPad Software, San Diego, Calif., USA). Results were considered statistically significant when $p<0.05$.

Results

Figure 6:
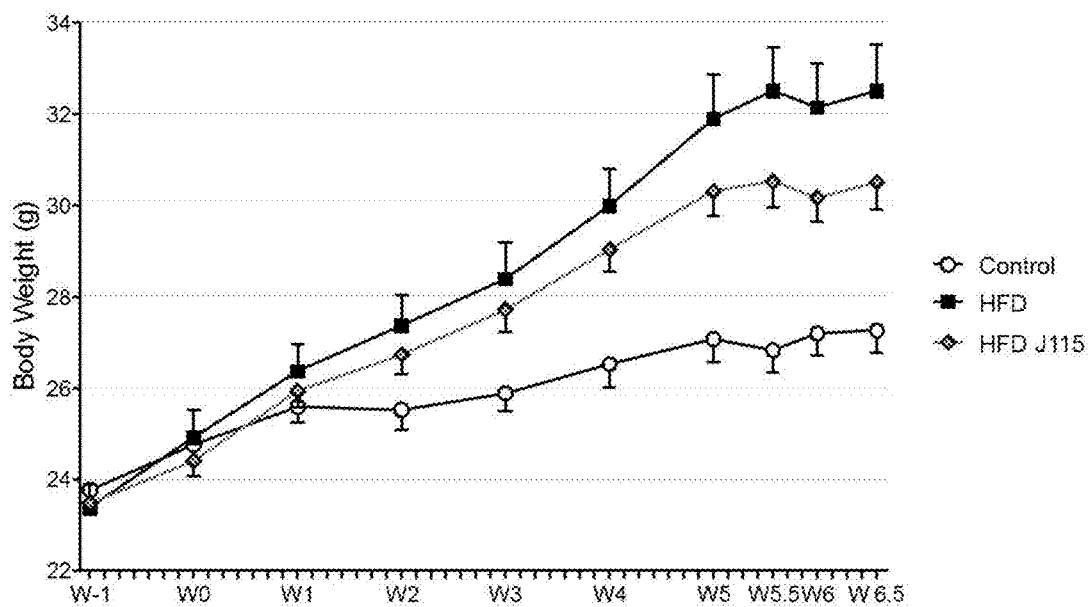
FIG. 6 is a graph showing body weight curves of mice treated by daily oral gavage with *Dysosmobacter welbionis* J115 (10$^9$ bacterial cells suspended in 200 μL, sterile anaerobic phosphate-carbonate buffer saline (PCBS)) and fed a high-fat diet (HFD-*Dysosmobacter* J115) or mice fed a control diet (Control) or a high-fat diet (HFD) and treated by daily oral gavage with an equivalent volume of sterile anaerobic PCBS-carbonate for 8-weeks (n=10/group).
Figure 7:
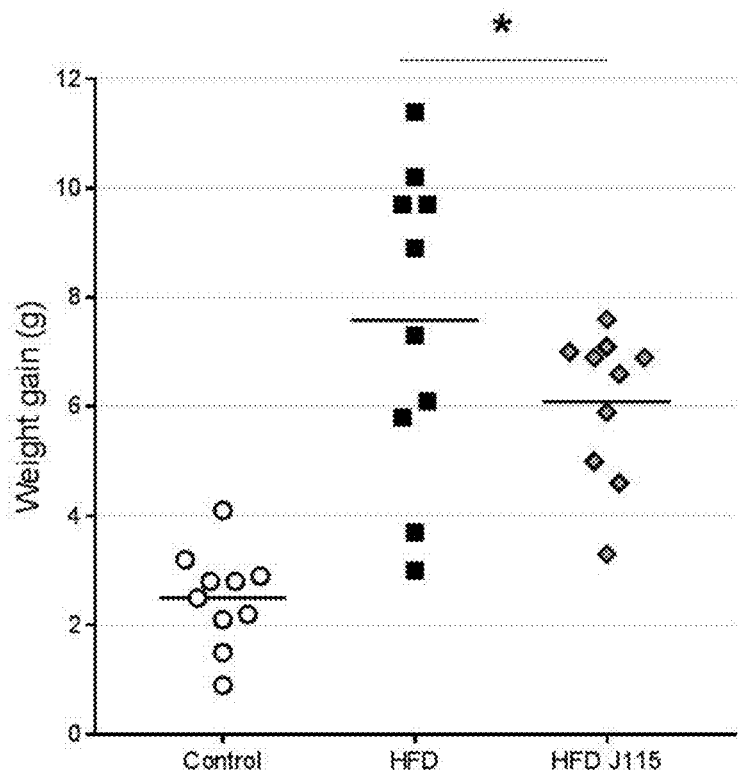
FIG. 7 is a graph showing weight gain measured for each group at the end of the 8-weeks treatment as described in FIG. 6. Data are shown as scatter dot plot with median. *: $p<0.05$, Kruskal-Wallis test followed by pairwise comparisons.
Figure 8:
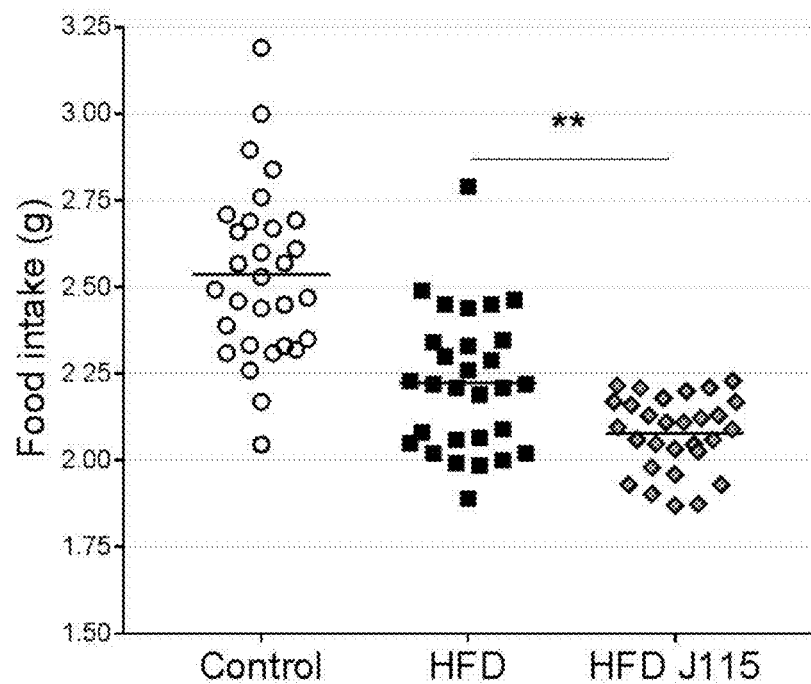
FIG. 8 is a graph showing the daily food intake per mouse, calculated based on weekly food intake of 2-mice cages during the 8-weeks treatment as described in FIG. 6. Data are shown as scatter dot plot with median. **: $p<0.01$, Kruskal-Wallis test followed by pairwise comparisons.
Figure 9:
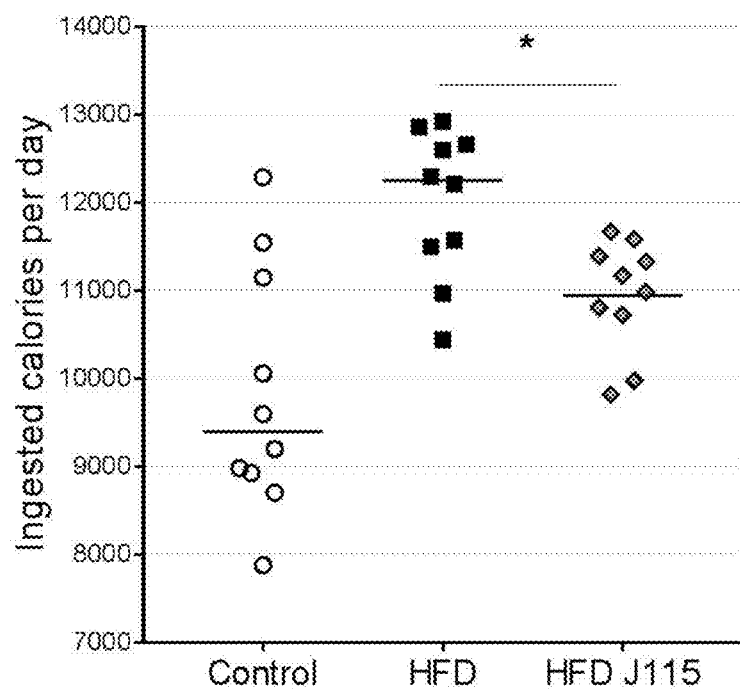
FIG. 9 is a graph showing the daily amount of calories ingested per mouse during weeks 6 and 7 of the 8-weeks treatment as described in FIG. 6. Data are shown as scatter dot plot with median. *: $p<0.05$, Kruskal-Wallis test followed by pairwise comparisons.
Figure 10:
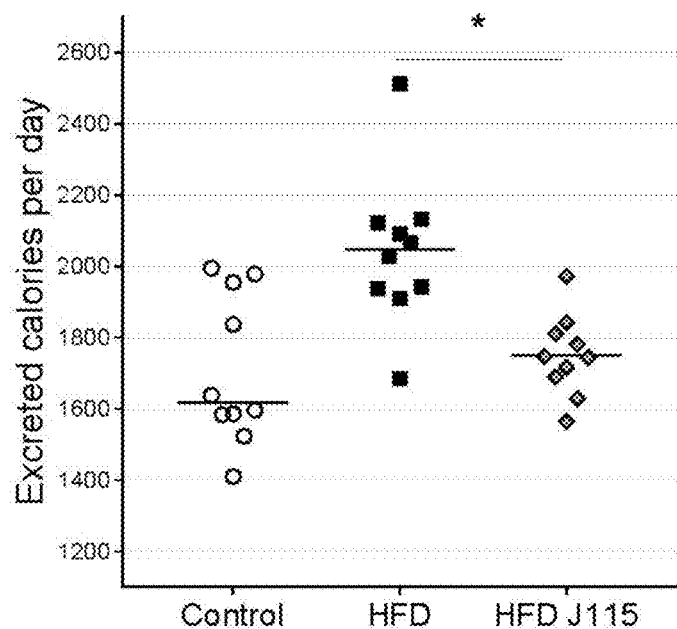
FIG. 10 is a graph showing the daily amount of calories excreted (fecal energy output) per mouse during weeks 6 and 7 of the 8-weeks treatment as described in FIG. 6. Data are shown as scatter dot plot with median. *: $p<0.05$, Kruskal-Wallis test followed by pairwise comparisons.
Figure 11:
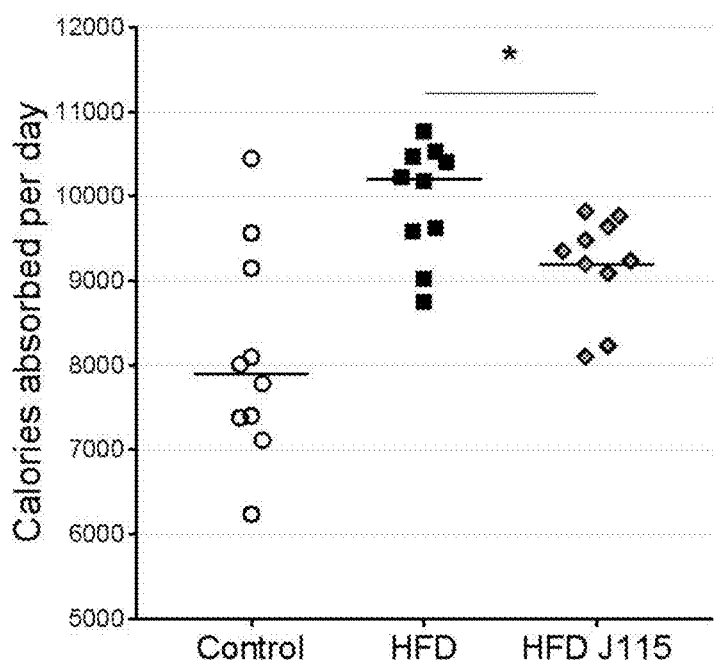
FIG. 11 is a graph showing the daily amount of calories absorbed (absorbed energy) per mouse during weeks 6 and 7 of the 8-weeks treatment as described in FIG. 6. Data are shown as scatter dot plot with median. *: $p<0.05$, Kruskal-Wallis test followed by pairwise comparisons.
Figure 12:
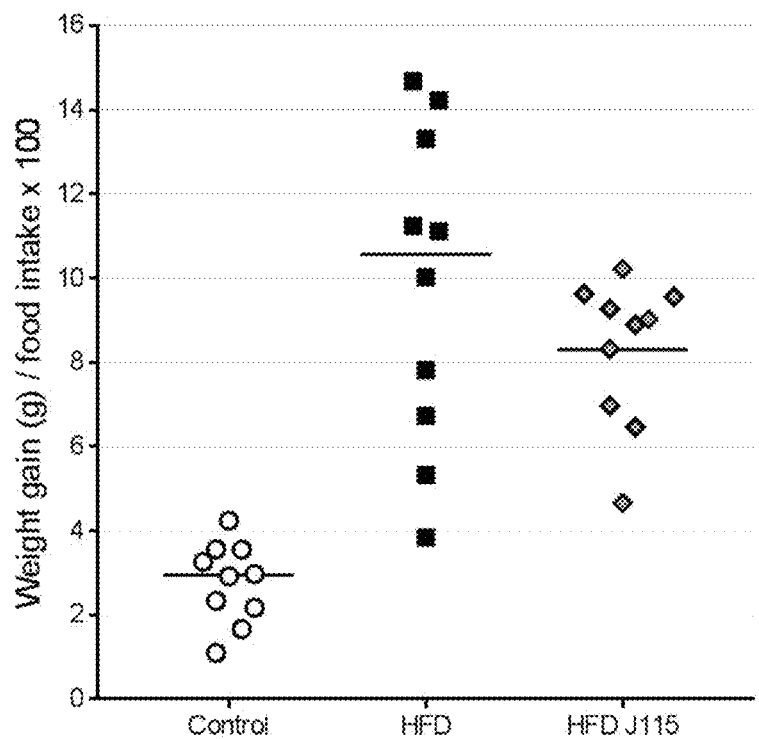
FIG. 12 is a graph showing the ratio of weight gain over the food intake at the end of the 8-weeks treatment as described in FIG. 6. Data are shown as scatter dot plot with median.

To decipher if and how *Dysosmobacter welbionis* affects host metabolic health, the bacterium J115 was orally administered to high-fat fed mice during eight weeks. Results show that supplementation with $10^9$ *D. welbionis* cells per day decreased by 29% (i.e. 1.5 grams) high-fat induced weight gain (FIG. 6 and FIG. 7). Additionally, results also show that *D. welbionis* administration significantly decreased food intake and thus total energy intake by 5% over the course of the experiment (FIG. 8 and FIG. 9). To verify that this decreased food intake indeed resulted in a decrease in the energy available for host metabolism, the feces of two seven days periods were collected and the total energy contained in those feces was measured by bomb calorimetry. Energy output in the feces was decreased by *D. welbionis* administration (FIG. 10), however, the net intestinal absorption remained 7.7% lower than in HFD mice (FIG. 11). Furthermore, the ratio of weight gain over food intake was 15.5% lower in *D. welbionis* supplemented mice than in HFD mice (FIG. 12). This indicates that *D. welbionis* decreased the ability to convert food energy into body mass. Taken together, these results show that *D. welbionis* prevents high fat diet induced weight gain by two means: a decrease of food intake and a decrease of the ability to store the absorbed energy.

Figure 13:
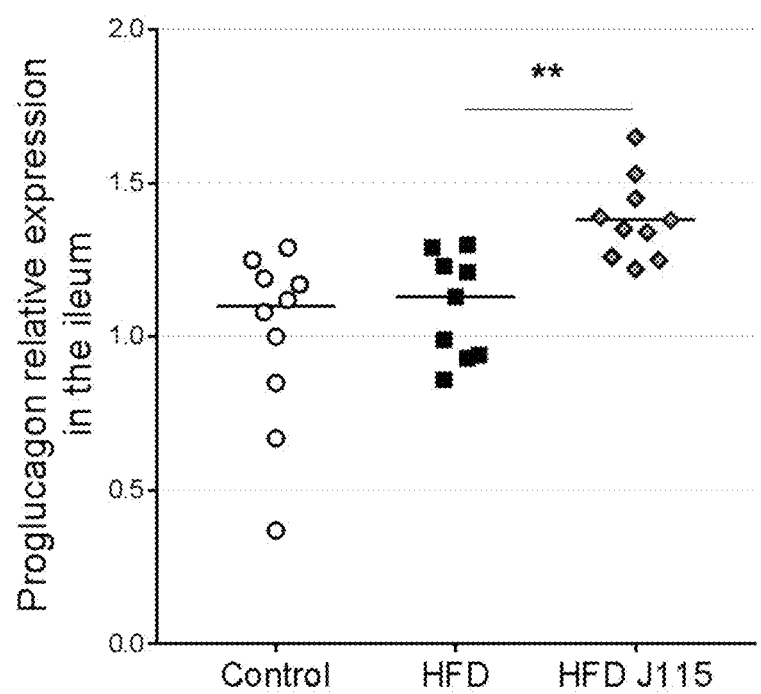
FIG. 13 is a graph showing Proglucagon mRNA expression levels measured in the terminal ileum at the end of the 8-weeks treatment as described in FIG. 6. Data are shown as scatter dot plot with median. **: $p<0.01$, Kruskal-Wallis test followed by pairwise comparisons.

Glucagon-like peptide-1 (GLP1) is a protein secreted by the intestine in the blood that regulates satiety and thus, food intake, both in human and animals. GLP1 in encoded by the proglucagon gene, which is expressed by L-cells of the intestine mucosa. The expression of the proglucagon gene in the ileum was measured and it was found that *D. welbionis* administration increased proglucagon ileal expression by 26% (FIG. 13).

Figure 14:
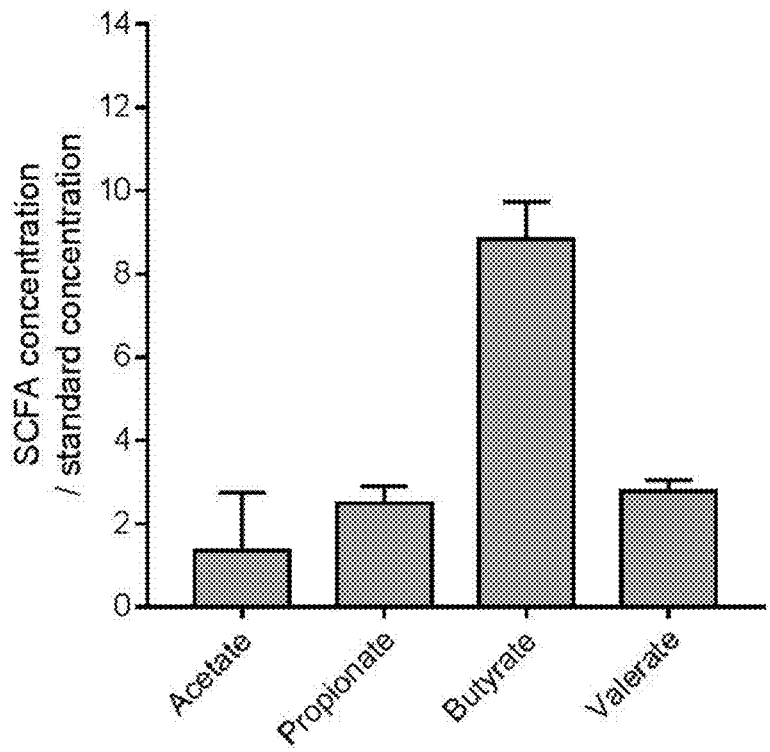
FIG. 14 is a histogram showing the short chain fatty acid (SCFA) produced by *Dysosmobacter welbionis* strain J115 in vitro.
Figure 15:
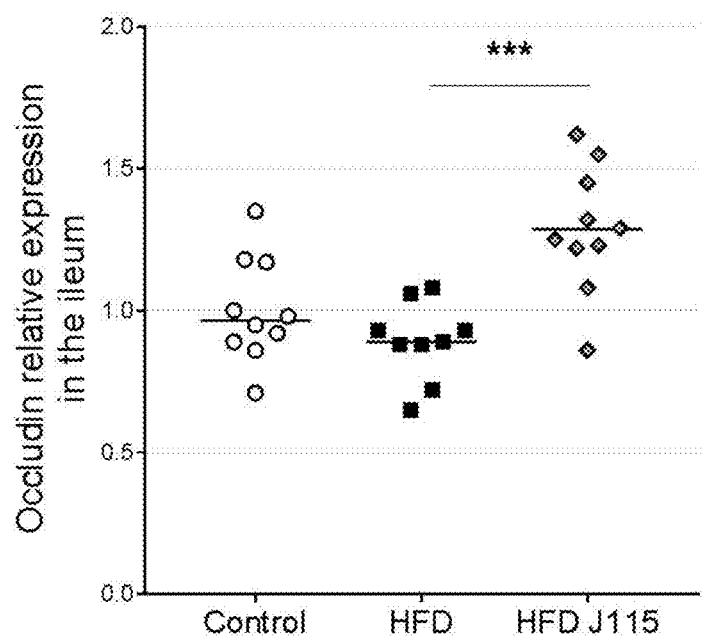
FIG. 15 is a graph showing occludin mRNA expression level measured in the terminal ileum at the end of the 8-weeks treatment as described in FIG. 6. Data are shown as scatter dot plot with median. *: $p<0.05$, Kruskal-Wallis test followed by pairwise comparisons.

As short chain fatty acids (SCFA) production by intestinal microbiota has a regulatory role on host metabolism and immunity, both locally and peripherally, SCFA production by *D. welbionis* was measured in vitro. SCFA are end-products of carbohydrates fermentation by intestinal bacterial, they are, known to activate G protein-coupled receptors (GPCR) 41 and 43, which are found at the apical membrane of L-cells. GPCR41/43 activation leads to a strengthening of the gut barrier through a stimulation of the expression of tight junction proteins. Tight junction proteins are proteins found at the lateral membrane of epithelial cells in the intestine and their junction ensures the integrity of the epithelium. *D. welbionis* produced large amounts of SCFA, butyrate in particular (FIG. 14). The inventors thus hypothesized that *D. welbionis* administration strengthens gut barrier and measured the mRNA expression of the gene coding for the tight junction protein Occludin and Claudin 3 (FIG. 15 and data not shown). Consistently with this hypothesis, an increase in the expression of occludin and claudin 3 was found in the ileum of mice treated with *D. welbionis*.

Conclusion

Together, these observations all point to a role of *D. welbionis* in the metabolism and integrity of the intestinal epithelial barrier in the host organism.

More specifically, the daily administration of $10^9$ J115 cells in mice, lead to the amelioration of several deleterious consequences associated with an high fat diet: a decrease of the gain of weight, a decrease in food intake, a decrease of the gain of weight per food intake, a decrease in energy absorption in the intestine and the increase of proglucagon mRNA expression. These observations point to the beneficial effect of the administration of J115 for the treatment of metabolic diseases (notably obesity) and feeding behavior disorders.

In addition, the daily administration of $10^9$ J115 cells in mice increase the amount of SCFA and the expression of tight junction markers, suggesting a reinforcement of the intestinal bather associated with the administration of J115. These observations point to a beneficial effect of the administration of J115 for the treatment of diseases associated with a dysfunctional intestinal bather notably intestinal inflammations, Crohn's disease, ulcerative colitis, food allergies, celiac disease, ulcers, infection, non-alcoholic steatohepatitis, colon cancer.

Example 6: Effects of the Administration of *D. Welbionis* on GLP-1 Production and Secretion Material and Methods In Vitro GLP-1 Production Assay Enteroendocrine cells from the intestinal murine L cell line GLUTag cells were used from passage 17 to 28. Cells were grown in DMEM GlutaMAX supplemented with 10% (v/v) inactivated FBS and 1% (v/v) penicillin/streptomycin, at 37° C. in a 5% $CO_2$/95% air atmosphere. GLUTag cells ($1.8\times10^5$ cells/well) were seeded into 24-well cell culture plates, 500 µL per well, and allowed to adhere for 24 h. The day after, cells were treated for 2 h with *D. welbionis* J115$^T$ at concentrations ranging from $1\cdot10^7$ to $2\cdot10^9$ cells/mL in the presence of DPP-IV inhibitor (dipeptidyl peptidase-4) at 50 µM final concentration. Total GLP-1 (glucagon like peptide-1) concentrations were determined with the Meso Scale Discovery ELISA kits (MesoScale, Gaithersburg, USA) and expressed as the amount of GLP-1 detected in the supernatant, and the total amount of GLP-1 in the medium plus cells.

Results

Figure 16:
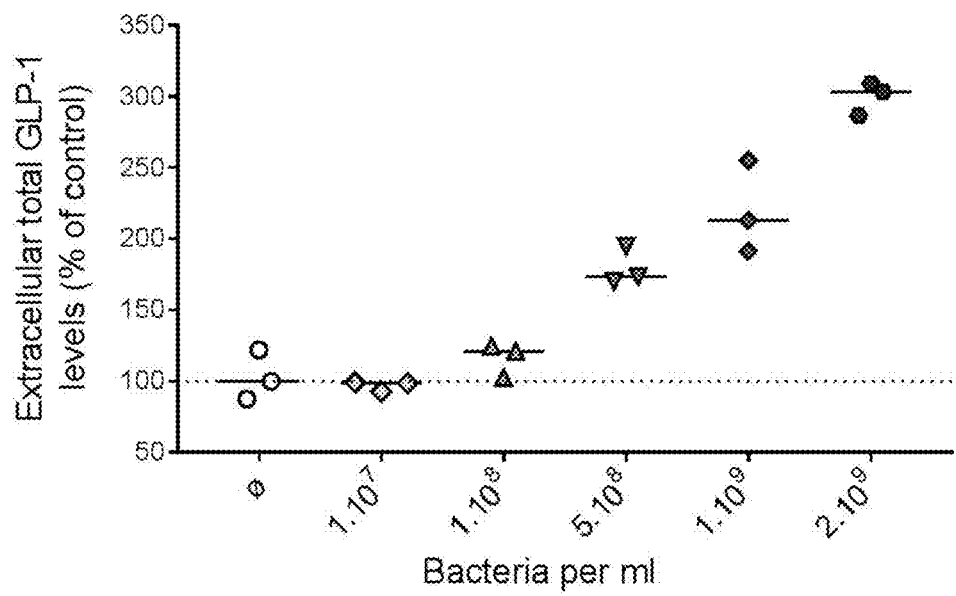
FIG. 16 is a graph showing the relative concentration of total GLP-1 in the supernatant of GLUtag cells after 2 hours of exposition to different concentration of *D. welbionis* J115$^T$. Data are shown as scatter dot plot with median.
Figure 17:
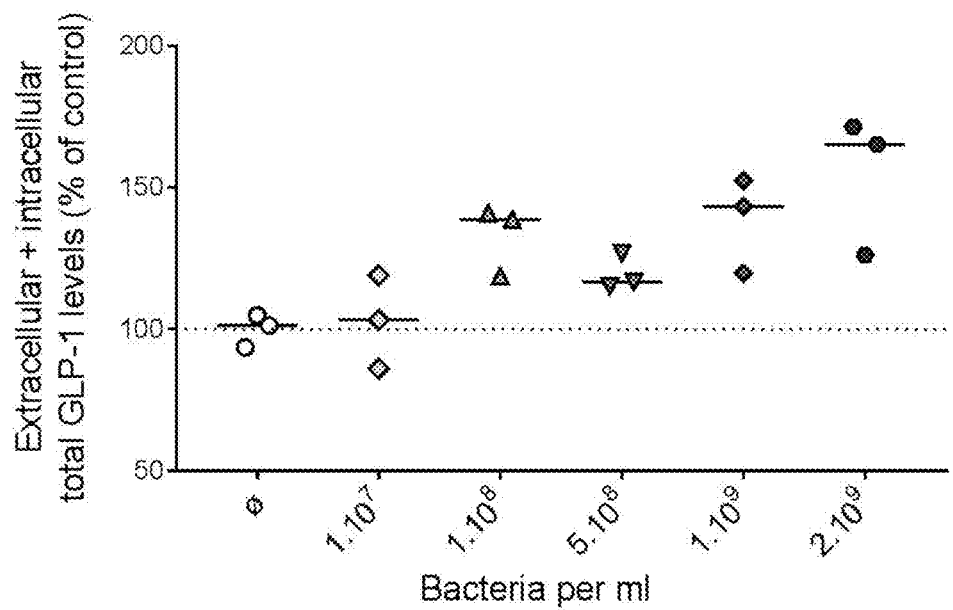
FIG. 17 is a graph showing the sum of the extracellular (supernatant) and intracellular, relative concentration of GLP-1 in GLUtag cells after 2 hours of exposition to different concentration of *D. welbionis* J115$^T$. Data are shown as scatter dot plot with median.

As GLP-1 secretion by enteroendocrine cells not only contributes to strengthen the intestinal barrier but also reduce food intake, we sought to confirm that *D. welbionis* J115$^T$ triggers GLP-1 production and secretion by enteroendocrine cells. Thus, cells from the intestinal murine L cells line GLUTag were subjected to increasing concentration of *D. welbionis* J115$^T$. The extracellular concentration of total GLP-1 was not increased by $1·10^7$ cells/mL but was increased by 16.2%, 79.5%, 119.69% and 199.7% when exposed to increased concentrations of *D. welbionis* J115$^T$ such as $1·10^8$, $5·10^8$, $1·10^9$ and $2·10^9$ cells per mL, respectively (FIG. 16). This result demonstrates that *D. welbionis* J115$^T$ induces GLP-1 secretion by enteroendocrine cells. In order to decipher if *D. welbionis* J115$^T$ also raises the production of GLP-1, the total quantity of GLP-1 produced by the GLUtag cells during the challenge was measured, that is to say the sum of intracellular and extracellular amounts of GLP-1. The total amount of GLP-1 was not affected by $1·10^7$ cells/mL but was increased by 32.9%, 19.5%, 38.5% and 54.3% by concentrations of $1·10^8$, $5·10^8$, $1·10^9$ and $2·10^9$ cells per mL, respectively (FIG. 17). Therefore, showing that *D. welbionis* J115$^T$ increases endogenous production of glucagon-like peptides (e.g., GLP1 and GLP-2).

Conclusion

Consistently with the increase expression of proglucagon observed in mice terminal ileum following *D. welbionis* J115$^{1'}$ administration, a dose-dependent increase of both secreted and total GLP-1 following exposure to *D. welbionis* J115$^T$ is observed. As GLP-2 production is associated with the increase of GLP-1 production (Drucker et al., Best Pract Res Clin Endocrinol Metab. 2004 December; 18(4):531-54) These results are indicative of a role stimulatory effect of *D. welbionis* J115$^T$ on GLP-1 and GLP-2 production and secretion.

GLP-1 is associated with the reduction of energy intake, higher energy expenditure, higher secretion of insulin, lower insulin resistance and satiety. GLP-2 is associated with a strengthening of the gut barrier, an induction of proliferative and cytoprotective pathways in the small bowel the intestinal barrier Therefore, these observations also point to a beneficial effect of the administration of J115 for the treatment of diseases associated with a dysfunctional intestinal barrier and/or feeding disorders.

Example 7: Influence of Dose and Viability on the Effect Associated with the Administration of *D. welbionis*

Material and Methods

*Dysosmobacter Welbionis* J115$^T$ Cultivation and Enumeration

*D. welbionis* J115$^T$ (LMG P-30603) was grown anaerobically in a modified YCFA medium enriched with inositol as previously described (Le Roy et al, published in Int J Syst Evol Microbiol, 2019, DOI 10.1099/ijsem.0.003547).

Fresh cultures of *D. welbionis* J115$^T$ were prepared each day administered to the mice belonging to the HFD-J115 fresh group. Cultures were transferred into 50 mL tubes in an anaerobic chamber, then centrifuged at 5000 g during 20 min. Then, the supernatant was removed and the pellet resuspended in the appropriate volume of or trehalose 15% in phosphate-carbonate buffer saline to obtain the desired end concentration in number of cells/mL, calculated from the culture's optical density.

Frozen suspensions of *D. welbionis* J115$^T$ were prepared in one batch before the beginning of the experiment and then frozen, an aliquot was thawed every day for the daily administration to mice and was depicted as the HFD J115 frozen group. Briefly, cultures were transferred into 50 mL tubes in an anaerobic chamber, then centrifuged at 5000 g during 20 min. Then, the supernatant was removed and the pellet resuspended in the appropriate volume of trehalose 15% in phosphate-carbonate buffer saline to obtain the desired end concentration. Finally, the suspension was transferred in anaerobic sterile vials and stored at −20° C.

Live bacteria in fresh and frozen suspensions were enumerated by performing 1:10 serial dilutions of the suspension in anaerobic phosphate-carbonate buffer. 100 μL of each dilution was then plated in triplicates on pre-reduced agar YCFA petri dishes. Colonies were counted after 5 days of incubation at 37° C. in anaerobic jars.

Mice

A set of 10-week-old C57BL/6J mice (48 mice, n=12/group) (Janvier Labs, France) were housed in SPF (specific pathogen free) environment by groups of 2 mice/cage, with free access to food and water. The mice were fed a control diet (CT) or a high-fat diet (HFD). A group of mice was treated with an oral administration of daily prepared fresh cultures of *D. welbionis* J115$^T$ by oral gavage at the dose $5·10^9$ bacteria/0.2 mL (corresponding to $2·10^9$ cfu/0.2 mL) suspended in sterile anaerobic solution of trehalose 15% in phosphate-carbonate buffer saline (HFD J115 fresh). Another group of mice was treated with frozen solution of *D. welbionis* J115$^T$ by oral gavage at the dose $5·10^9$ bacteria/0.2 mL (corresponding to $3,5·10^8$ cfu/mL) suspended in sterile anaerobic solution of trehalose 15% in phosphate-carbonate buffer saline (HFD J115 frozen). HFD and control groups were treated with an oral gavage of an equivalent volume of trehalose 15% in phosphate-carbonate buffer saline (Control and HFD). Treatment continued for 13 weeks. Mice were euthanized after a 6 h fasting period.

Food and water intake were recorded once a week. Body composition was assessed by using 7.5 MHz time domain-nuclear magnetic resonance (TD-NMR) (LF50 minispec, Bruker, Rheinstetten, Germany).

Intestinal Energy Absorption

Six weeks after the beginning of the experiment, the feces of two seven-days periods were collected. During the same time the food intake was monitored. The feces were dried at 60° C. during 2 hours and weighted. Total energy of the diet and the feces was determined by bomb calorimetry (C1, IKA, USA). The net intestinal absorption is calculated based on the ingested and excreted energy and represented the proportion of ingested energy that was not recovered in feces output.

Results

Figure 18:
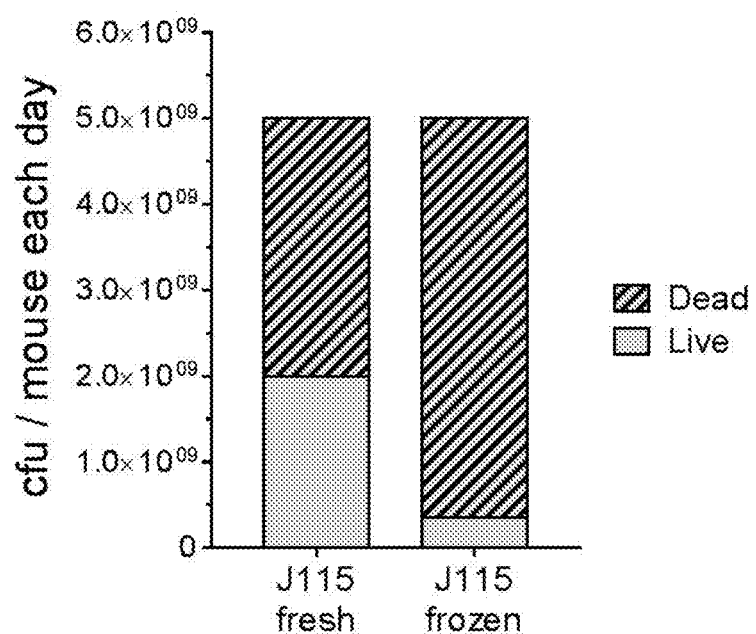
FIG. 18 is a graph showing the amount of dead and live cells of *D. welbionis* J115$^T$ in the fresh and frozen suspensions administered per mouse and per day.

To decipher if dosage and/or viability of *Dysosmobacter welbionis* J115$^T$ influences the protection against HFD-induced obesity and the metabolic alterations and if frozen bacteria are as active as daily-cultivated bacteria, $5·10^9$ fresh and frozen bacteria were administered per day to HFD-fed mice for 13 weeks. Enumeration of cfu before and after preparation for daily fresh administration indicated that 40% of the bacteria survived, thus a $5·10^9$ cell dose correspond to $2·10^9$ live, that is to say cultivable, bacteria (FIG. 18). Conversely, enumeration before and after preparation of frozen bacteria indicated that only 7% of the bacteria survived, thus a $5·10^9$ cell dose corresponds to $3.5·10^8$ cultivable bacteria (FIG. 18).

Figure 19:
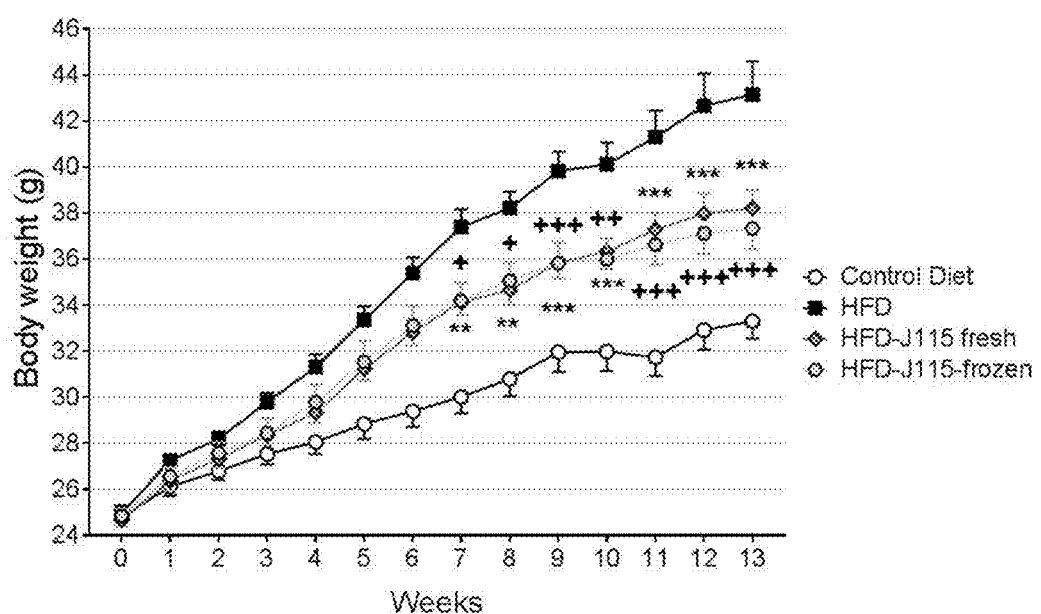
FIG. 19 is a graph showing the body weight evolution of mice treated by daily oral gavage with fresh and frozen suspensions of 5·10$^9$ cells of *D. welbionis* J115$^T$ and fed a HF-diet (HFD-J115-fresh and HFD-J115-frozen, respectively) or mice fed a control diet (Control) or a high-fat diet (HFD) and treated by daily oral gavage with an equivalent volume of sterile trehalose 15% in anaerobic PBS-carbonate buffer saline for 13-weeks (n=12/group). Stars or (+) signs indicate significant differences (* or +:p<0.05;  or ++:p<0.01; * or +++:p<0.001) between two groups according to statistical analysis consisting of one-way ANOVA followed by pairwise comparisons and Tukey correction. * indicate statistical significance between HFD and HFD-J115-fresh groups while+indicate statistical significance between HFD and HFD-J115-frozen groups.
Figure 20:
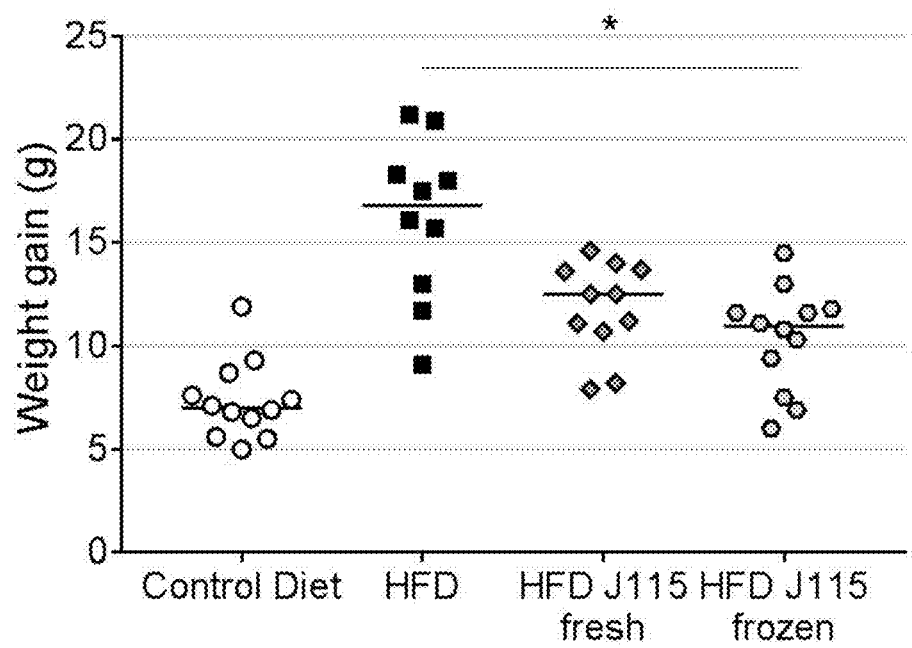
FIG. 20 is a graph showing the total body weight gain of mice treated by daily oral gavage with fresh and frozen suspensions of 5·10$^9$ *D. welbionis* J115$^T$ and fed a HF-diet (HFD-J115-fresh and HFD-J115-frozen, respectively) or mice fed a control diet (Control) or a high-fat diet (HFD) and treated by daily oral gavage with an equivalent volume of sterile trehalose 15% in anaerobic PBS-carbonate buffer saline for 13-weeks (n=12/group), measured at the end of the 13-weeks period. Stars indicate significant differences (*: p<0.05) between two groups according to statistical analysis consisting of one-way ANOVA followed by pairwise comparisons and Tukey correction.
Figure 21:
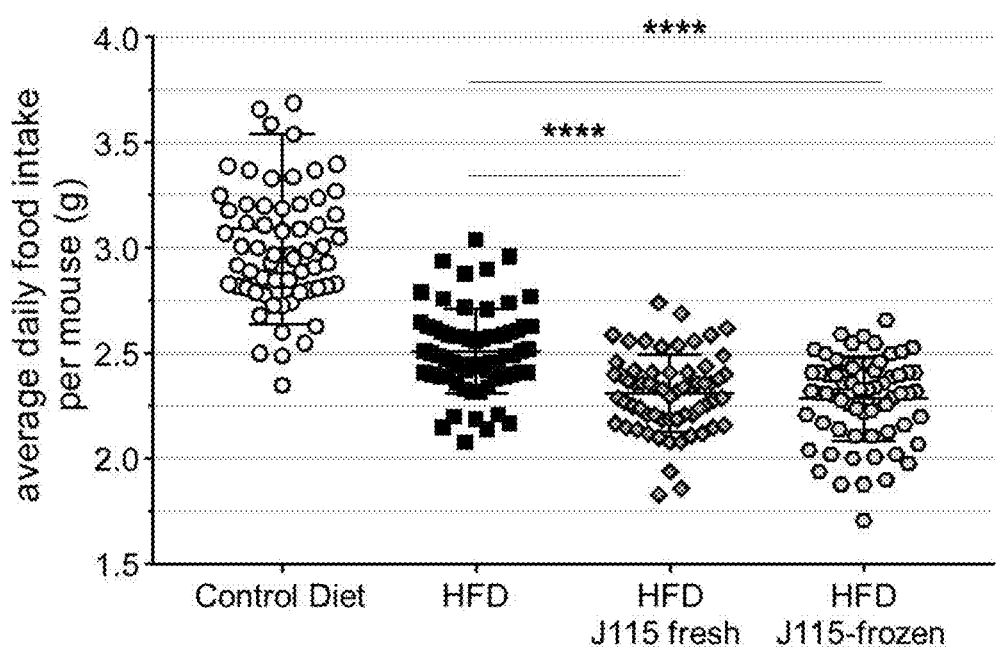
FIG. 21 is a graph showing the daily food intake per mouse and per day of mice treated by daily oral gavage with fresh and frozen suspensions of 5·10$^9$ *D. welbionis* J115$^T$ and fed a HF-diet (HFD-J115-fresh and HFD-J115-frozen, respectively) or mice fed a control diet (Control) or a high-fat diet (HFD) and treated by daily oral gavage with an equivalent volume of sterile trehalose 15% in anaerobic PBS-carbonate buffer saline for 13-weeks (n=12/group), calculated based of weekly food intake of 2 mice cages over the 13-weeks period. Stars indicate significant differences (****: p<0.0001) between two groups according to statistical analysis consisting of one-way ANOVA followed by pairwise comparisons and Tukey correction.
Figure 22:
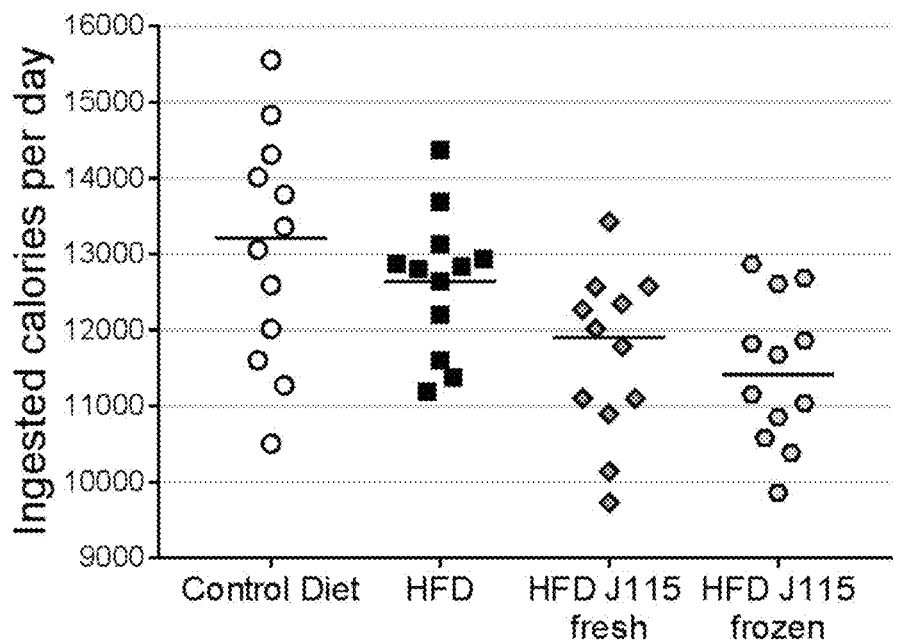
FIG. 22 is a graph showing the ingested energy (calories) per day and per mouse of mice treated by daily oral gavage with fresh and frozen suspensions of 5·10$^9$ *D. welbionis* J115$^T$ and fed a HF-diet (HFD-J115-fresh and HFD-J115-frozen, respectively) or mice fed a control diet (Control) or a high-fat diet (HFD) and treated by daily oral gavage with an equivalent volume of sterile trehalose 15% in anaerobic PBS-carbonate buffer saline for 13-weeks (n=12/group), during weeks 6 and 8 of the experiment. Data are shown as scatter dot plot with median.
Figure 23:
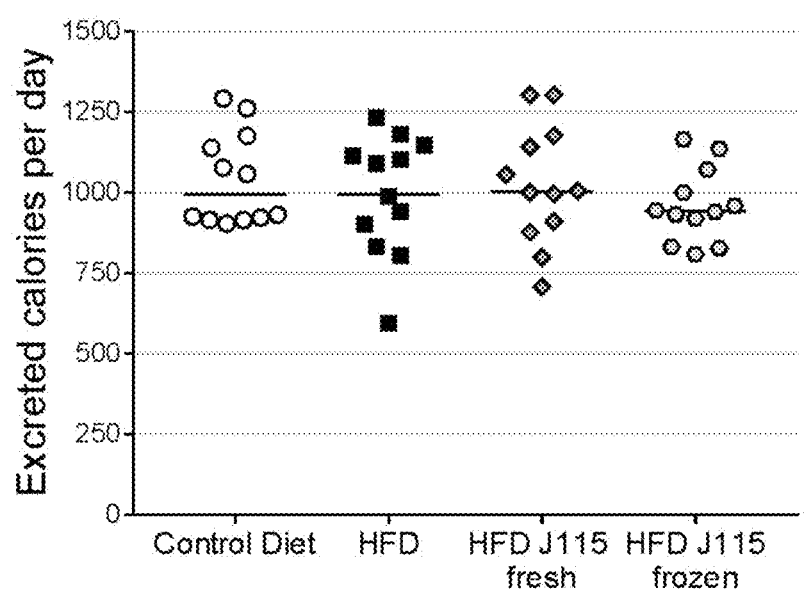
FIG. 23 is a graph showing the fecal energy output (excreted calories) per day and per mouse of mice treated by daily oral gavage with fresh and frozen suspensions of 5·10$^9$ *D. welbionis* J115$^T$ and fed a HF-diet (HFD-J115-fresh and HFD-J115-frozen, respectively) or mice fed a control diet (Control) or a high-fat diet (HFD) and treated by daily oral gavage with an equivalent volume of sterile trehalose 15% in anaerobic PBS-carbonate buffer saline for 13-weeks (n=12/group), during weeks 6 and 8 of the experiment. Data are shown as scatter dot plot with median.
Figure 24:
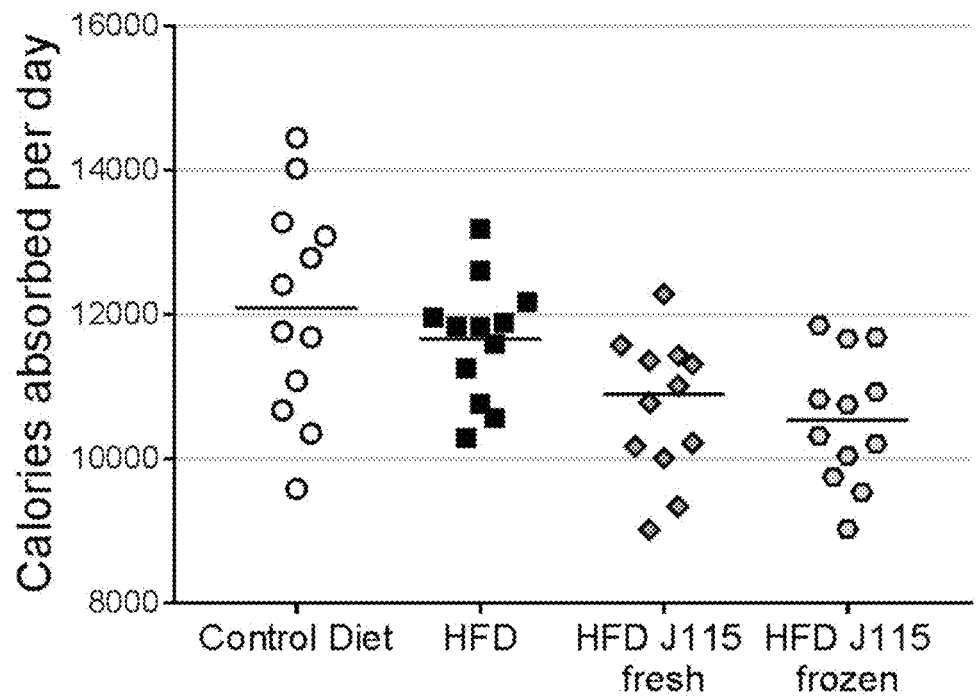
FIG. 24 is a graph showing the absorbed energy (calories) per day and per mouse of mice treated by daily oral gavage with fresh and frozen suspensions of 5·10$^9$ *D. welbionis* J115$^T$ and fed a HF-diet (HFD-J115-fresh and HFD-J115-frozen, respectively) or mice fed a control diet (Control) or a high-fat diet (HFD) and treated by daily oral gavage with an equivalent volume of sterile trehalose 15% in anaerobic PBS-carbonate buffer saline for 13-weeks (n=12/group), during weeks 6 and 8 of the experiment. Daily oral gavage with fresh or frozen 5·10$^9$ cells of *Dysosmobacter welbionis* J115$^T$. Data are shown as scatter dot plot with median.
Figure 25:
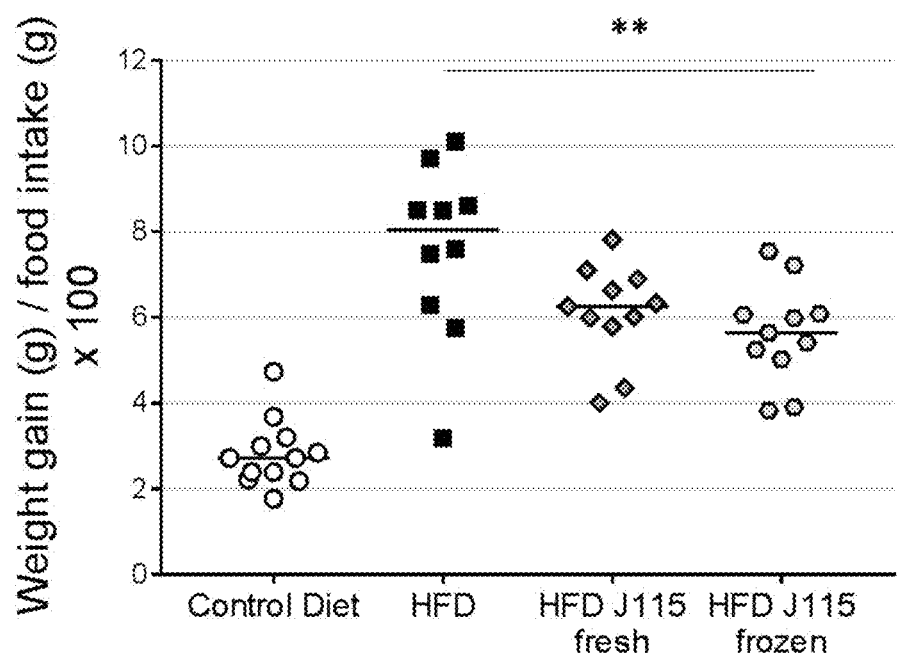
FIG. 25 is a graph showing the ratio of weight gain over the food intake of mice treated by daily oral gavage with fresh and frozen suspensions of 5·10$^9$ *D. welbionis* J115$^T$ and fed a HF-diet (HFD-J115-fresh and HFD-J115-frozen, respectively) or mice fed a control diet (Control) or a high-fat diet (HFD) and treated by daily oral gavage with an equivalent volume of sterile trehalose 15% in anaerobic PBS-carbonate buffer saline for 13-weeks (n=12/group), at the end of the 13 weeks experiment. Data are shown as scatter dot plot with median. Stars indicate significant differences (**: p<0.01) between two groups according to statistical analysis consisting of one-way ANOVA followed by pairwise comparisons and Tukey correction.

Results show that supplementation with $5·10^9$ freshly prepared bacteria per day decreased HFD-induced weight gain by and 24.7 and 26.8% (i.e., 3.5 and 4.9 g) after 8 and 13 weeks of treatment, respectively (FIG. 19 and FIG. 20). Similarly, supplementation with $5 \cdot 10^9$ frozen bacteria per day decreased HFD-induced weight gain by 22.8 and 33.3% (i.e., 3.1 and 5.8 g) after 8 and 13 weeks of treatment, respectively (FIG. 19 and FIG. 20). The extent of the effect of the fresh and frozen preparation is similar after 8 weeks of treatment and slightly higher for the frozen preparation, although not statistically significant, at the end of the study (13 weeks). As $D.$ $welbionis$ $J115^T$ preparations with the same total amount but different viability levels exert the same physiological effect on mice, it appears that the viability is not a necessary feature to obtain anti-obesity action. In other words, dead, non-cultivable cells of $D.$ $welbionis$ $J115^T$ have the same beneficial properties than live, cultivable, cells of $D.$ $welbionis$ $J115^T$. Fresh and frozen $D.$ $welbionis$ $J115^T$ administration significantly decreased food intake and thus total energy intake by 7.9 and 9.0% over the course of the experiment (FIG. 21). To verify that this decreased food intake indeed resulted in a decrease in the energy available for host metabolism, the feces of two periods of seven days were collected and the total energy contained in those feces was measured by bomb calorimetry. Energy output in the feces was not affected by fresh or frozen $D.$ $welbionis$ administration (FIG. 22 and FIG. 23), however, the quantity of calories absorbed remained 8.2 and 9.5% lower than in HFD mice (FIG. 24). Furthermore, the ratio of weight gain over food intake was 19.5 and 25.6% lower in fresh and frozen $D.$ $welbionis$ supplemented mice than in HFD mice (FIG. 25). This indicates that $D.$ $welbionis$ decreased the ability to convert food energy into body mass. Taken together, this result show that $D.$ $welbionis$ prevents high fat diet induced weight by two complementary mechanisms, that is a decreased food intake and a lower ability to store the absorbed energy.

Conclusion

These results confirm the observations made in example 5 that the administration of J115 lead to the amelioration of several deleterious consequences associated with an high fat diet: a decrease of the gain of weight, a decrease in food intake, a decrease of the gain of weight per food intake and a decrease in energy absorption in the intestine. These observations point to the beneficial effect of the administration of J115 for the treatment of metabolic diseases (notably obesity) and feeding disorders. These effects are confirmed for a daily dose of $5 \cdot 10^9$ J115 cells/mice and are observed over a range of $3.5 \cdot 10^8$ to $2 \cdot 10^9$ viable/cultivable J115 cells/mice/day. Notably the administration of frozen J115 cells, comprising 7% viable/cultivable cells is as efficient as not frozen preparation comprising 40% viable/cultivable cells. This suggest that not viable J115 cells are also able to ameliorate health in respect to the several deleterious consequences associated with an high fat diet: a decrease of the gain of weight, a decrease in food intake, a decrease of the gain of weight per food intake and a decrease in energy absorption in the intestine.

Example 8: Effect of $D.$ $welbionis$ Administration on Adipose Tissues

Material and Methods $Dysosmobacter$ $Welbionis$ $J115^T$ Cultivation and Enumeration Cf. corresponding section in Example 7.

Mice

Cf. corresponding section in Example 7.

Tissue Sampling

The animals were anesthetized with isoflurane (Forene®, Abbott, Queenborough, Kent, England) before exsanguination and tissue sampling, then mice were killed by cervical dislocation. The intestinal segments (duodenum, jejunum, ileum, cecum and colon) were dissected, immersed in liquid nitrogen, and stored at −80° C., for further analysis.

Adipocytes Diameter in Subcutaneous and Mesenteric Adipose Tissues

Paraffin sections of 5 µm were stained with hematoxylin and eosin. Images were obtained using a SCN400 slide scanner and Digital Image Hub software (Leica Biosystems, Wetzlar, Germany). Adipocytes size and distribution were calculated from five fields per sample using Fiji and Adiposoft softwares.

Results

Figure 26:
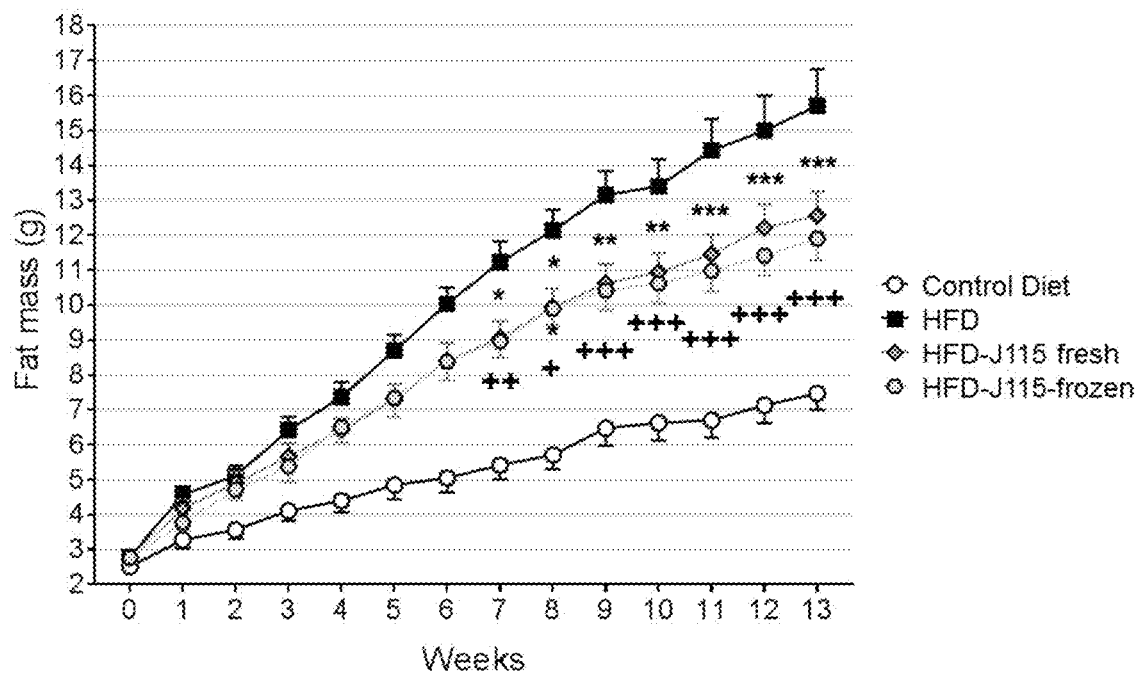
FIG. 26 is a graph showing the total fat mass evolution of mice treated by daily oral gavage with fresh and frozen suspensions of 5·10$^9$ cells of *D. welbionis* J115$^T$ and fed a HF-diet (HFD-J115-fresh and HFD-J115-frozen, respectively) or mice fed a control diet (Control) or a high-fat diet (HFD) and treated by daily oral gavage with an equivalent volume of sterile trehalose 15% in anaerobic PBS-carbonate buffer saline for 13-weeks (n=12/group). Data are shown as scatter dot plot with median. Stars and plus signs indicate significant differences (* or +:p<0.05;  or ++:p<0.01; * or +++:p<0.001) between two groups according to statistical analysis consisting of one-way ANOVA followed by pairwise comparisons and Tukey correction. * indicate statistical significance between HFD and HFD-J115-fresh groups while +indicate statistical significance between HFD and HFD-J115-frozen groups.
Figure 27:
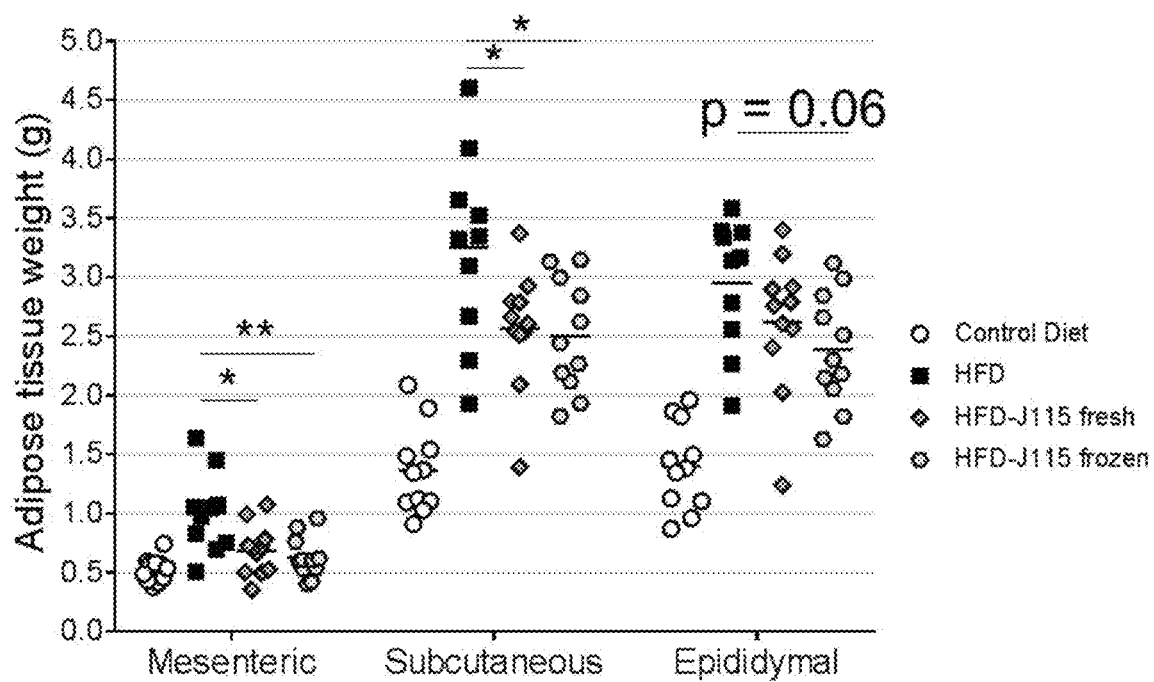
FIG. 27 is a graph showing the mesenteric, subcutaneous and epididymal fat pads weight of mice treated by daily oral gavage with fresh and frozen suspensions of 5·10$^9$ cells of *D. welbionis* J115$^T$ and fed a HF-diet (HFD-J115-fresh and HFD-J115-frozen, respectively) or mice fed a control diet (Control) or a high-fat diet (HFD) and treated by daily oral gavage with an equivalent volume of sterile trehalose 15% in anaerobic PBS-carbonate buffer saline for 13-weeks (n=12/group), at the end of the 13-weeks period. Data are shown as scatter dot plot with median. Stars indicate significant differences (*: p<0.05; : p<0.01; *: p<0.001) between two groups according to statistical analysis consisting of one-way ANOVA followed by pairwise comparisons and Tukey correction.
Figure 28:
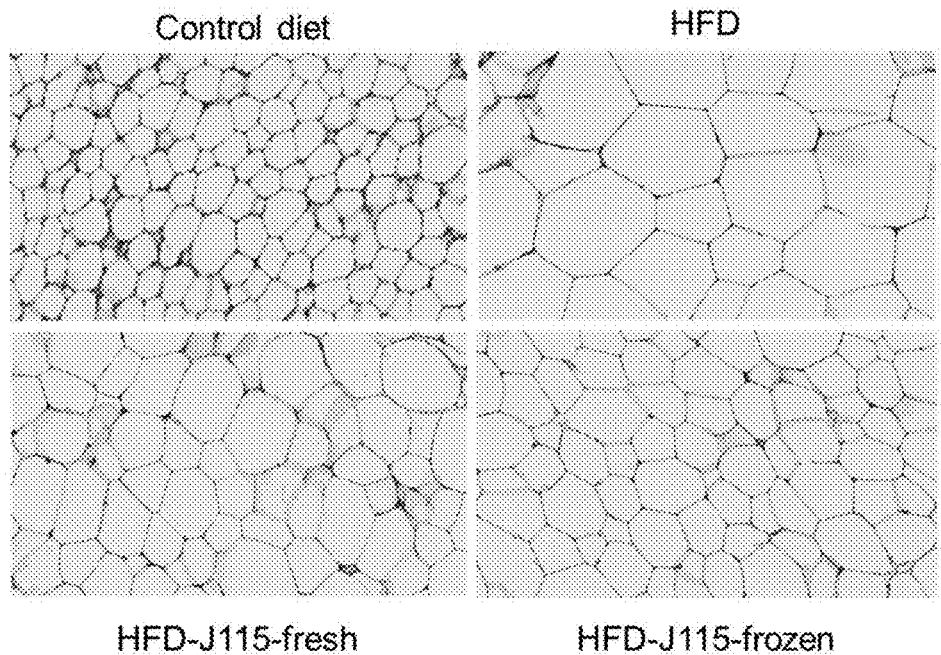
FIG. 28 is series of representative hematoxylin and eosin (H&E)-stained pictures of subcutaneous adipose tissue (SCAT) of mice treated by daily oral gavage with fresh and frozen suspensions of 5·10$^9$ cells of *D. welbionis* J115$^T$ and fed a HF-diet (HFD-J115-fresh and HFD-J115-frozen, respectively) or mice fed a control diet (Control) or a high-fat diet (HFD) and treated by daily oral gavage with an equivalent volume of sterile trehalose 15% in anaerobic PBS-carbonate buffer saline for 13-weeks (n=12/group), at the end of the 13-weeks period.
Figure 29:
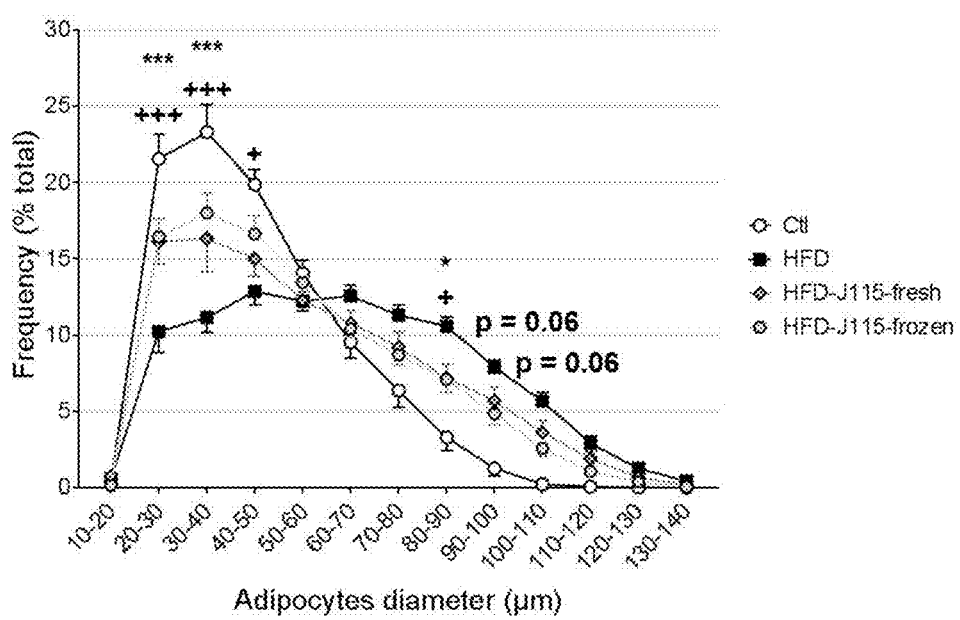
FIG. 29 is a graph showing Adipocytes diameter (μm) distribution in the SCAT of mice treated by daily oral gavage with fresh and frozen suspensions of $5 \cdot 10^9$ cells of *D. welbionis* $J115^T$ and fed a HF-diet (HFD-J115-fresh and HFD-J115-frozen, respectively) or mice fed a control diet (Control) or a high-fat diet (HFD) and treated by daily oral gavage with an equivalent volume of sterile trehalose 15% in anaerobic PBS-carbonate buffer saline for 13-weeks (n=12/group), at the end of the 13-weeks period. Data are shown as scatter dot plot with median. Stars and plus signs indicate significant differences (* or +: $p<0.05$;  or ++: $p<0.01$; * or +++: $p<0.001$) between two groups according to statistical analysis consisting of one-way ANOVA followed by pairwise comparisons and Tukey correction. * indicate statistical significance between HFD and HFD-J115-fresh groups while +indicate statistical significance between HFD and HFD-J115-frozen groups.
Figure 30:
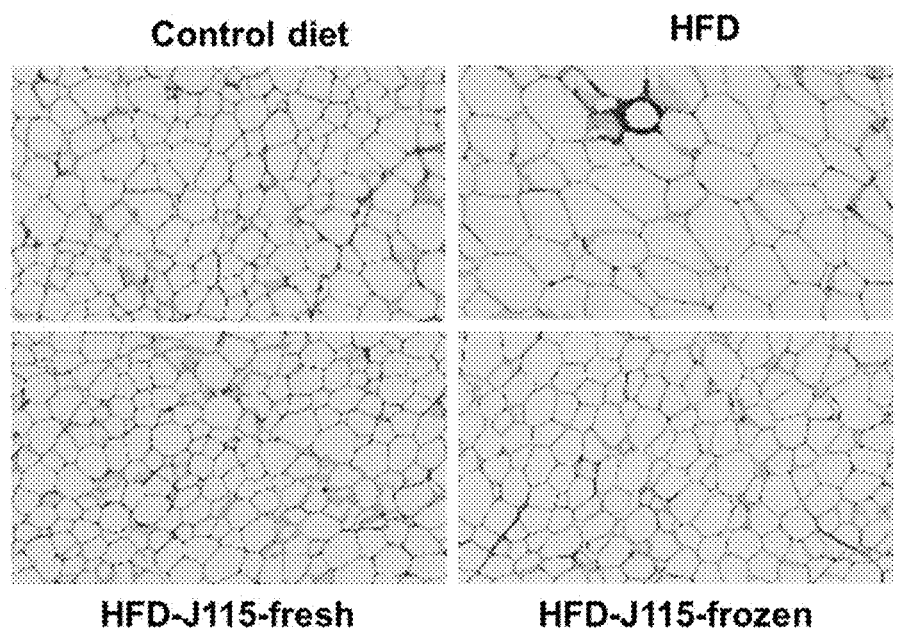
FIG. 30 is series of representative hematoxylin and eosin (H&E)-stained pictures of mesenteric adipose tissue (MAT) of mice treated by daily oral gavage with fresh and frozen suspensions of $5 \cdot 10^9$ cells of *D. welbionis* $J115^T$ and fed a HF-diet (HFD-J115-fresh and HFD-J115-frozen, respectively) or mice fed a control diet (Control) or a high-fat diet (HFD) and treated by daily oral gavage with an equivalent volume of sterile trehalose 15% in anaerobic PBS-carbonate buffer saline for 13-weeks (n=12/group), at the end of the 13-weeks period.
Figure 31:
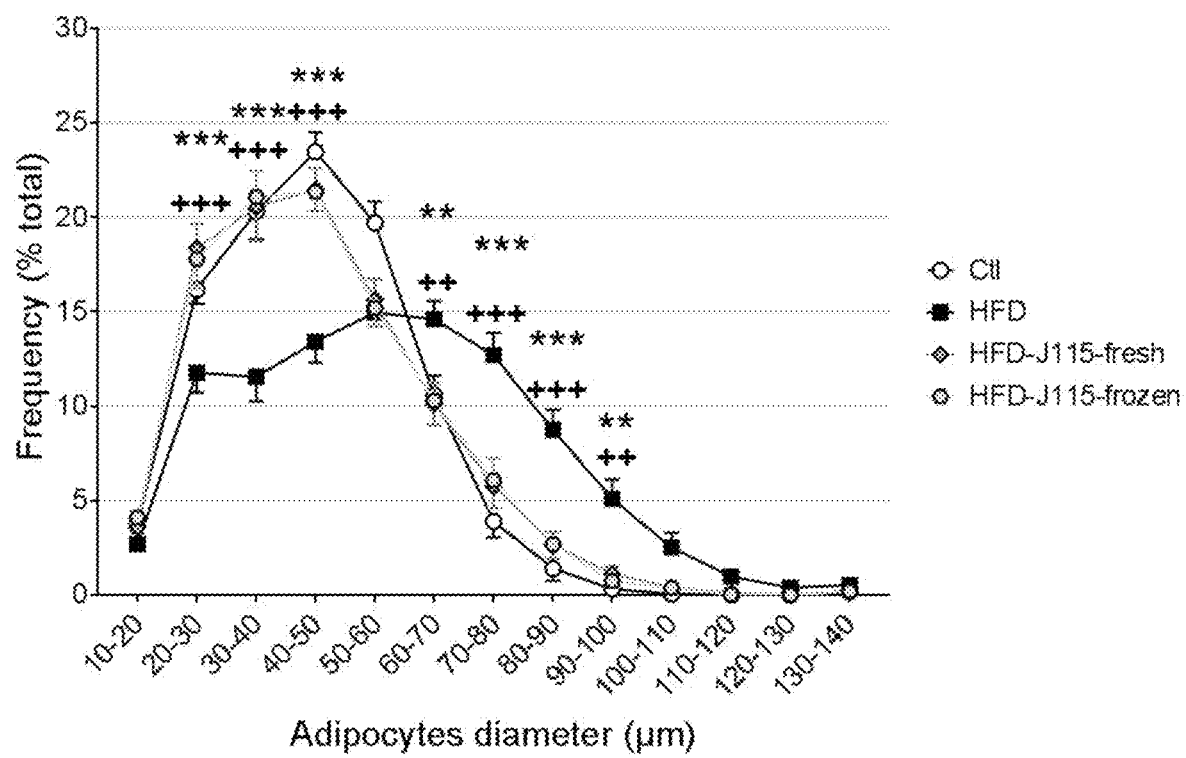
FIG. 31 is a graph showing adipocytes diameter (μm) distribution in the MAT of mice treated by daily oral gavage with fresh and frozen suspensions of $5 \cdot 10^9$ cells of *D. welbionis* $J115^T$ and fed a HF-diet (HFD-J115-fresh and HFD-J115-frozen, respectively) or mice fed a control diet (Control) or a high-fat diet (HFD) and treated by daily oral gavage with an equivalent volume of sterile trehalose 15% in anaerobic PBS-carbonate buffer saline for 13-weeks (n=12/group), at the end of the 13-weeks period. Data are shown as scatter dot plot with median. Stars and plus signs indicate significant differences (* or +: $p<0.05$;  or ++: $p<0.01$; * or +++: $p<0.001$) between two groups according to statistical analysis consisting of one-way ANOVA followed by pairwise comparisons and Tukey correction. * indicate statistical significance between HFD and HFD-J115-fresh groups while + indicate statistical significance between HFD and HFD-J115-frozen groups.

Obesity is associated with fat deposits expansion and disturbed adipose tissue function characterized by adipocyte hypertrophy, impaired lipolysis and pro-inflammatory phenotype, which contributes to insulin resistance and ectopic fat deposit. Results show that supplementation with fresh and frozen $5 \cdot 10^9$ $D.$ $welbionis$ $J115^T$ cells per day decreased by 20.0 and 24.2% (i.e., 3.1 and 3.8 grams) high-fat induced adipose tissue weight gain (FIG. 26). This corresponds to significant decreases of the weight of mesenteric, subcutaneous (inguinal) and epididymal fat deposits (FIG. 27). As adipocytes hypertrophy is characteristic of adipocytes dysfunction, adipocyte diameter was measured in the subcutaneous (SCAT) and mesenteric (MAT) adipose tissue by histology and image analysis. Fresh and frozen $D.$ $welbionis$ $J115^T$ treatment significantly increased the proportion of small adipocytes (diameter inferior to 50 µm) and decreased the proportion of large adipocytes (diameter above 70 µm) in SCAT (FIG. 28 and FIG. 29). Visceral adipose tissue dysfunction is particularly associated to metabolic alteration, thus adipocytes size and distribution in MAT was also measured. Supplementation with fresh and frozen $D.$ $welbionis$ $J115^T$ cells per day significantly increased the proportion of small adipocytes and decreased the proportion of large adipocytes in MAT (FIG. 30 and FIG. 31). Strikingly, $D.$ $welbionis$ $J115^T$ treatment completely abolished HFD-induced MAT adipocytes hypertrophy as the adipocyte size distribution was identical in control diet fed mice and in HFD fed mice treated with fresh or frozen $D.$ $welbionis$ $J115^T$.

Conclusion

These results indicate that the administration of J115 lead to the amelioration of several deleterious consequences associated with an high fat diet: a decrease the weight of adipose tissue (including mesenteric, subcutaneous (inguinal) and epididymal fat deposits), a decrease of adipocyte hypertrophy (including in SCAT and MAT). These observations point to the beneficial effect of the administration of J115 for the treatment of metabolic diseases (notably obesity, metabolic syndrome, hypertension, ectopic fat deposition, type 2 diabetes and dyslipidemia). These effects are observed for a daily dose of $5 \cdot 10^9$ J115 cells/mice and are observed over a range of $3.5 \cdot 10^8$ to $2 \cdot 10^9$ viable/cultivable J115 cells/mice/day. Notably the administration of frozen J115 cells, comprising 7% viable/cultivable cells is as efficient as not frozen preparation comprising 40% viable/cultivable cells. This suggest that not viable J115 cells are also able to ameliorate health in respect to the several deleterious consequences associated with an high fat diet: a decrease the weight of adipose tissue (including mesenteric, subcutaneous (inguinal) and epididymal fat deposits), a decrease of adipocyte hypertrophy (including in SCAT and MAT).

Example 9: Effect of *D. welbionis* Administration on Metabolic Health

Material and Methods

*Dysosmobacter welbionis* J115$^T$ Cultivation and Enumeration

Cf. corresponding section in Example 7.

Mice

Cf. corresponding section in Example 7.

Oral Glucose Tolerance Test (OGTT)

After 13 weeks of treatment, six hours-fasted mice were treated with an oral gavage glucose load (2 g glucose per kg body weight). Blood glucose was measured 30 minutes and at time 0 just before oral glucose load and then 15, 30, 60, 90 and 120 min after oral glucose load. Blood glucose was determined with a glucose meter (Accu Check, Roche, Switzerland) on blood samples collected from the tip of the tail vein. Plasma insulin concentration was determined using an ELISA kit (Mercodia, Uppsala, Sweden) according to the manufacturer's instructions.

Fasting Leptin Concentration

Circulating leptin concentration was determined using a multiplex immunoassay kit (Mouse diabetes assay, Bio-Plex Pro, Bio-Rad, Belgium) and measured using Luminex technology (Bioplex, Bio-Rad, Belgium).

Results

Figure 32:
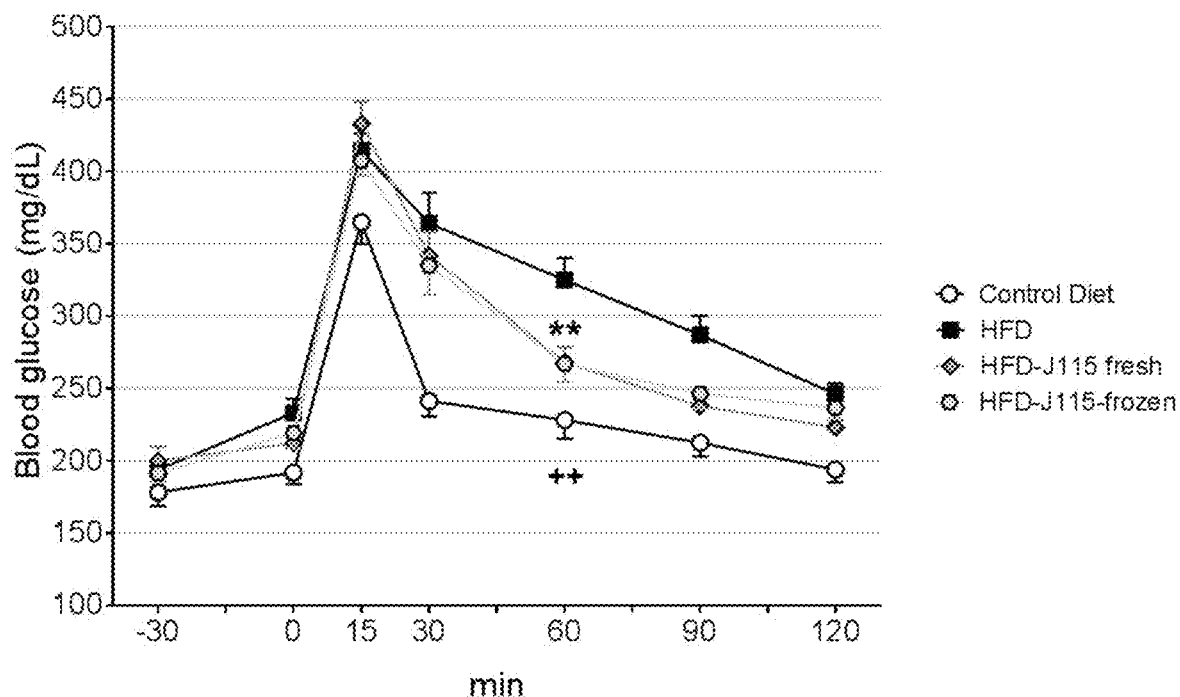
FIG. 32 is a graph showing plasma glucose (mg/dL) profile during oral glucose tolerance test (OGTT) of mice treated by daily oral gavage with fresh and frozen suspensions of $5 \cdot 10^9$ cells of *D. welbionis* $J115^T$ and fed a HF-diet (HFD-J115-fresh and HFD-J115-frozen, respectively) or mice fed a control diet (Control) or a high-fat diet (HFD) and treated by daily oral gavage with an equivalent volume of sterile trehalose 15% in anaerobic PBS-carbonate buffer saline for 13-weeks (n=12/group). Data are shown as scatter dot plot with median. Stars and plus signs indicate significant differences (* or +: $p<0.05$;  or ++: $p<0.01$; * or +++: $p<0.001$) between two groups according to statistical analysis consisting of one-way ANOVA followed by pairwise comparisons and Tukey correction. * indicate statistical significance between HFD and HFD-J115-fresh groups while + indicate statistical significance between HFD and HFD-J115-frozen groups.
Figure 33:
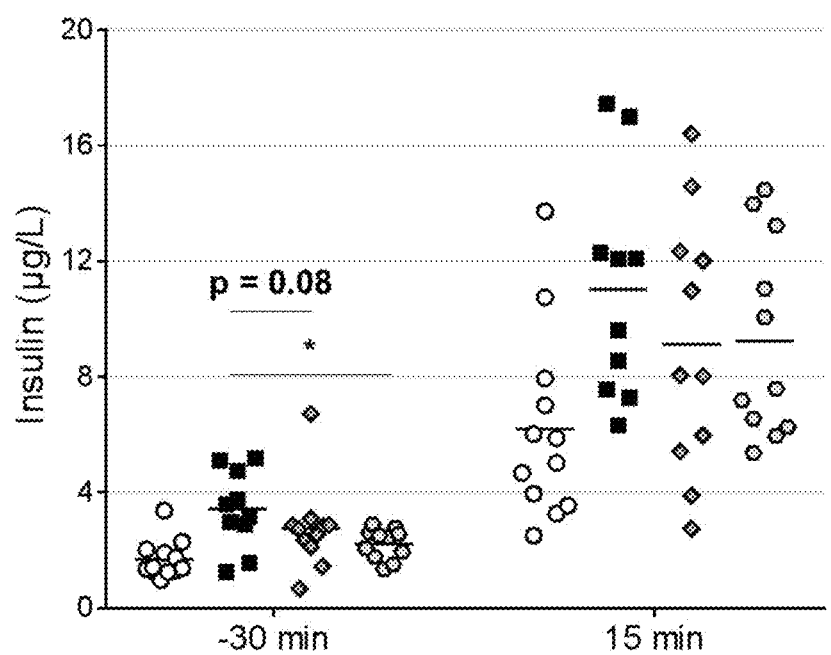
FIG. 33 is a graph showing plasma insulin concentration (μg/L) measured 30 min before and 15 min after glucose administration during the OGTT during oral glucose tolerance test (OGTT) of mice treated by daily oral gavage with fresh and frozen suspensions of $5 \cdot 10^9$ cells of *D. welbionis* $J115^T$ and fed a HF-diet (HFD-J115-fresh and HFD-J115-frozen, respectively) or mice fed a control diet (Control) or a high-fat diet (HFD) and treated by daily oral gavage with an equivalent volume of sterile trehalose 15% in anaerobic PBS-carbonate buffer saline for 13-weeks (n=12/group). Data are shown as scatter dot plot with median. Stars indicate significant differences (*: $p<0.05$) between two groups according to statistical analysis consisting of one-way ANOVA followed by pairwise comparisons and Tukey correction.
Figure 34:
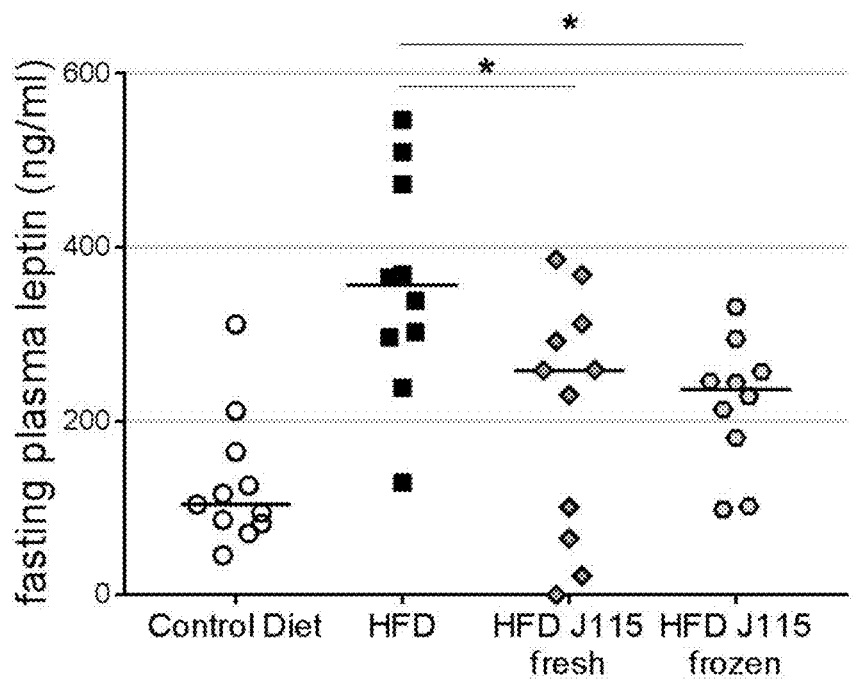
FIG. 34 is a graph showing fasting leptin concentration (ng/mL) in the plasma of mice treated by daily oral gavage with fresh and frozen suspensions of $5 \cdot 10^9$ cells of *D. welbionis* $J115^T$ and fed a HF-diet (HFD-J115-fresh and HFD-J115-frozen, respectively) or mice fed a control diet (Control) or a high-fat diet (HFD) and treated by daily oral gavage with an equivalent volume of sterile trehalose 15% in anaerobic PBS-carbonate buffer saline for 13-weeks (n=12/group). Data are shown as scatter dot plot with median. Stars indicate significant differences (*: $p<0.05$) between two groups according to statistical analysis consisting of one-way ANOVA followed by pairwise comparisons and Tukey correction.

In order to better characterize the impact of *D. welbionis* J115$^T$ treatment on glucose metabolism and metabolic health, oral glucose tolerance test were performed after 12 weeks of HFD and fresh and frozen *D. welbionis* J115$^T$ supplementation. Fasting plasma glucose was similar in treated and non-treated mice, as 15 min after glucose load. However, the decrease of plasma glucose was faster in mice supplemented with fresh and frozen *D. welbionis* J115$^T$ (FIG. 32). In addition, plasma insulin levels tended to be lower before and 15 min after the glucose load (FIG. 33) despite similar plasma glucose levels, indicating that insulin sensitivity was likely improved by fresh and frozen *D. welbionis* J115$^T$. Coherently with a better metabolic health, fasting plasma leptin levels were significantly lowered by fresh and frozen *D. welbionis* J115$^T$ (FIG. 34).

Conclusion

These results indicate that the administration of J115 lead to the amelioration of several deleterious consequences associated with an high fat diet: a decrease of glucose tolerance, of insulin sensitivity and a decrease of fasting plasma leptin level. These observations point to the beneficial effect of the administration of J115 for the treatment of metabolic diseases (notably obesity, insulin resistance, glucose intolerance, hyperglycemia, metabolic syndrome, type 2 diabetes, type 1 diabetes, dyslipidemia, altered endogenous glucose production). These effects are observed for a daily dose of 5·10$^9$ J115 cells/mice and are observed over a range of 3.5·10$^8$ to 2·10$^9$ viable/cultivable J115 cells/mice/day. Notably the administration of frozen J115 cells, comprising 7% viable/cultivable cells is as efficient as not frozen preparation comprising 40% viable/cultivable cells. This suggest that not viable J115 cells are also able to ameliorate health in respect to the several deleterious consequences associated with an high fat diet: a decrease of glucose tolerance, of insulin sensitivity and a decrease of fasting plasma leptin level.

Example 10: Effect of *D. welbionis* Administration on Brown and Subcutaneous Adipose Tissue Material and Methods

*Dysosmobacter Welbionis* J115$^T$ Cultivation and Enumeration

Cf. corresponding section in Example 7.

Mice

Figure 36:
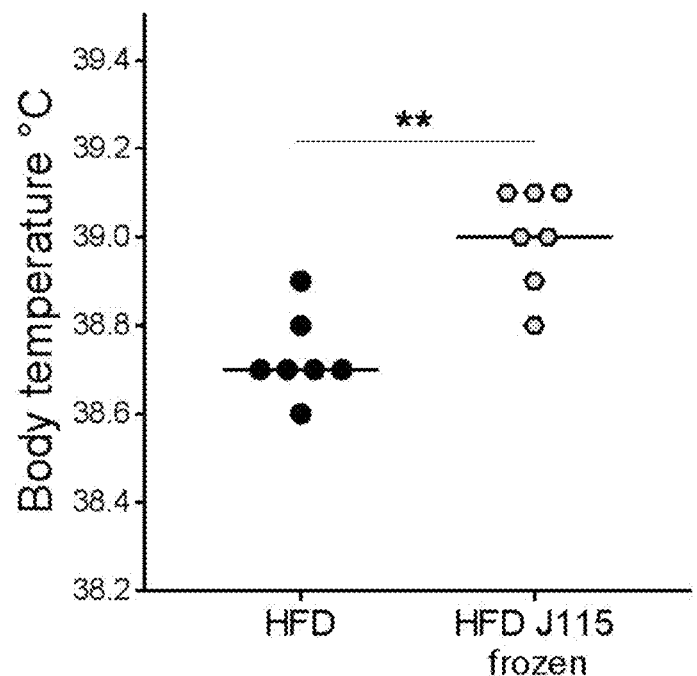
FIG. 36 is a graph showing body temperature of mice treated by daily oral gavage with frozen suspensions of $5 \cdot 10^9$ cells of *D. welbionis* $J115^T$ and fed a HF-diet (HFD-J115-fresh) or a high-fat diet (HFD) and treated by daily oral gavage with an equivalent volume of sterile trehalose 15% in anaerobic PBS-carbonate buffer saline for 3 weeks (n=7/group). Data are shown as scatter dot plot with median. Stars indicate significant differences (**: $p<0.01$) between two groups according to statistical analysis consisting of Mann-Whitney test.

Cf. corresponding section in Example 7. For experiment presented in FIGS. 36 and 37 a set of 10-week-old C57BL/6J mice (14 mice, n=7/group) (Janvier Labs, France) were housed individually, with free access to food and water. The mice were fed a high-fat diet (HFD). A group of mice was treated with frozen solution of *D. welbionis* J115$^T$ by oral gavage at the dose 5·10$^9$ bacteria/0.2 mL (corresponding to 3,5·10$^8$ cfu/mL) suspended in sterile anaerobic solution of trehalose 15% in phosphate-carbonate buffer saline (HFD J115 frozen). HFD groups was treated with an oral gavage of an equivalent volume of trehalose 15% in phosphate-carbonate buffer saline (HFD). Treatment continued for 3 weeks. On the last day of the experiment, the temperature of the mice was measured using a rodent rectal thermometer. Mice were euthanized in the morning with no fasting period.

Tissue Sampling

Cf. corresponding section in Example 8.

RNA Preparation, Real-Time qPCR and RNAseq Analysis

RNA preparation and qPCR analyses were realized as described in corresponding section in Example 5. The primer presented in table 8 bellow were used.

TABLE 8

Nucleotide sequence of the primer pairs used for the measurement of mRNAs expression level by qPCR.

| Primers | | Sequence | SEQ ID NO: |
|---|---|---|---|
| F4/80 | Forward | TGACAACCAGACGGCTTGTG | 11 |
| | Reverse | GCAGGCGAGGAAAAGATAGTGT | 12 |
| ColA1 | Forward | CCTCAGGGTATTGCTGGACAAC | 13 |
| | Reverse | ACCACTTGATCCAGAAGGACCTT | 14 |

For RNAseq analysis, the integrity of RNA from brown adipose tissue (BAT) and subcutaneous adipose tissue (SCAT) was determined using with the Agilent bioanalyzer 2100 system with the RNA 6000 Nano LabChip kit. BAT samples with an RNA integrity number inferior to 8 on a scale ranging from 0 to 10 were eliminated, as well as SCAT samples with an RNA integrity number inferior to 6.5. Then, samples were pooled (HFD pool and HFD-J115 pool) to an end concentration of 50 ng/μL. The samples have been sequenced by Eurofins Genomics, which consisted in purification of poly-A containing mRNA molecules, then mRNA fragmentation, random primed cDNA synthesis (strand specific), adapter ligation and adapter specific PCR amplification and finally paired-end Illumina sequencing with a read length of 2×150 bp. 80 to 90 million read pairs were obtained and analyzed on Galaxy server using RNA-STAR and htseq modules.

Results

Figure 35:
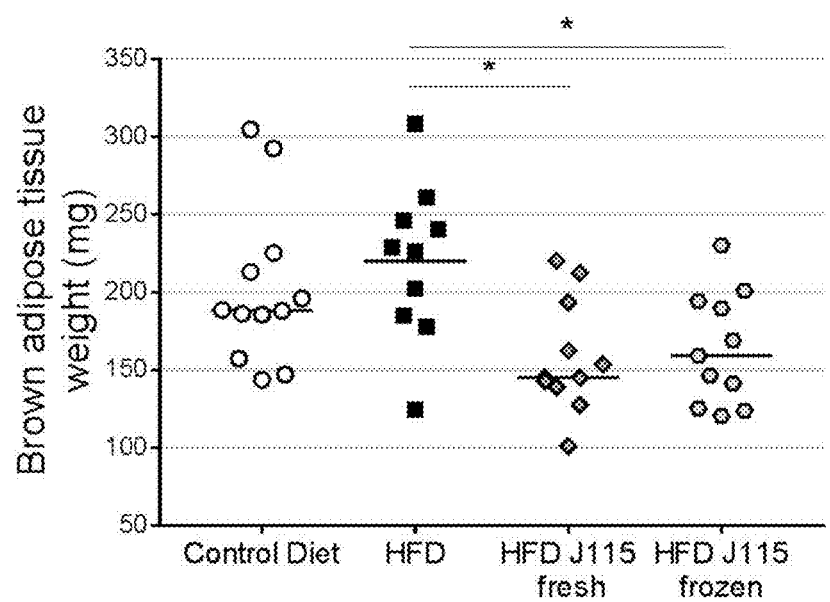
FIG. 35 is a graph showing interscapular brown adipose tissue (BAT) weight of mice treated by daily oral gavage with fresh and frozen suspensions of $5 \cdot 10^9$ cells of *D. welbionis* $J115^T$ and fed a HF-diet (HFD-J115-fresh and HFD-J115-frozen, respectively) or mice fed a control diet (Control) or a high-fat diet (HFD) and treated by daily oral gavage with an equivalent volume of sterile trehalose 15% in anaerobic PBS-carbonate buffer saline for 13-weeks (n=12/group). Data are shown as scatter dot plot with median. Stars indicate significant differences (*: $p<0.05$) between two groups according to statistical analysis consisting of one-way ANOVA followed by pairwise comparisons and Tukey correction.
Figure 37:
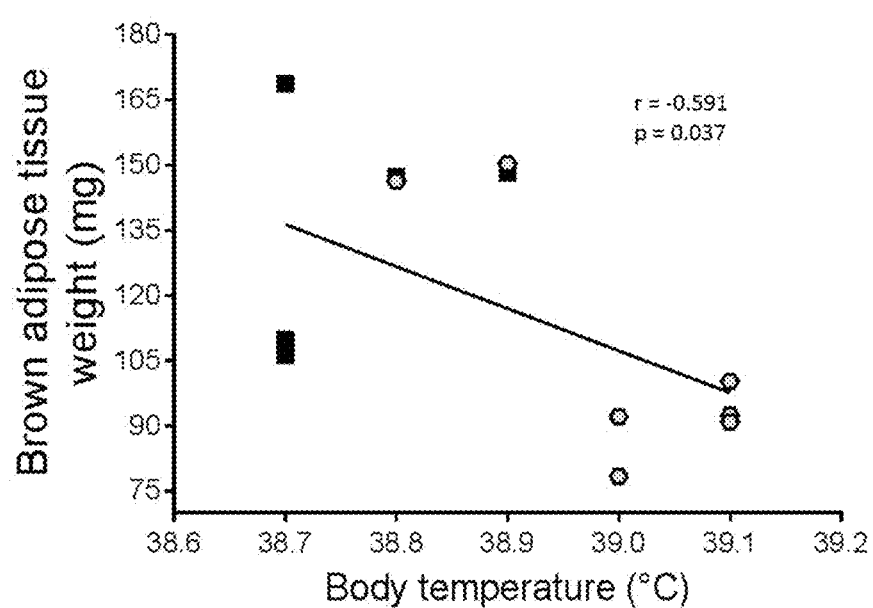
FIG. 37 is a graph showing the correlation between BAT weight and body temperature of mice treated by daily oral gavage with frozen suspensions of $5 \cdot 10^9$ cells of *D. welbionis* $J115^T$ and fed a HF-diet (HFD-J115-fresh) or a high-fat diet (HFD) and treated by daily oral gavage with an equivalent volume of sterile trehalose 15% in anaerobic PBS-carbonate buffer saline for 3 weeks (n=7/group). Data are shown as scatter dot plot with median. The p value is indicated according to statistical analysis consisting of Spearman correlation.

*D. welbionis* J115$^T$ decreased the ability to convert food energy into body mass. This phenomenon can be the consequence of increased energy expenditure. Brown adipose tissue (BAT) is a fat deposit that is particularly metabolically active. Indeed, it is the major site of non-shivering thermogenesis, thereby controlling whole-body temperature, energy expenditure and body fat. Results show that supplementation with $5 \cdot 10^9$ freshly prepared and frozen bacteria per day decreased the BAT weight by 24.7 and 26.8% (i.e., 61.6 and 56.4 mg) after 13 weeks of treatment, respectively (FIG. 35). In order to confirm the effect of D. welbionis J115$^T$ on body temperature and energy expenditure through the modulation of BAT metabolism, a set of 10-week-old HFD-fed C57BL/6J mice were subjected to a 3-weeks treatment with either vehicle or $5 \cdot 10^9$ frozen cells of D. welbionis J115$^T$ (14 mice, n=7/group, experiment 3). The body temperature of mice treated with frozen D. welbionis J115$^T$ was 0.27° C. higher than the body temperature of control mice fed a HFD and treated with vehicle (39.0° C. vs 38.73° C., FIG. 36). In addition, the BAT weight of those mice was negatively correlated with the body temperature (FIG. 37). Fibrosis and inflammation are increasingly appreciated as triggers of adipose tissue dysfunction. To determine if the adipose tissue metabolism improvement observed in mice treated with D. welbionis J115$^T$ derives from lower inflammation and fibrosis levels, RNAseq analysis was performed in the BAT and SCAT of HFD and the HFD-J115-frozen groups. The 22 genes related to extra-cellular matrix, that is too abundant in fibrosis, were down-regulated, in the BAT and SCAT of mice treated with frozen D. welbionis J115$^T$ (Table 9).

TABLE 9

RNAseq analysis in BAT and SCAT, representing the relative expression of genes related to fibrosis and extra-cellular matrix of mice treated by daily oral gavage with frozen suspensions of $5.10^9$ cells of D. welbionis J115$^T$ and fed a HF-diet relative to mice fed a high-fat diet (HFD) and treated by daily oral gavage with an equivalent volume of sterile trehalose 15% in anaerobic PBS-carbonate buffer saline for 13-weeks (n = 12/group).

| Gene | Fold-change HFD-J115-frozen/HFD | |
|---|---|---|
| | BAT | SCAT |
| Col3a1 | 0.53 | 0.6 |
| Col1a2 | 0.45 | 0.6 |
| Col6a1 | 0.72 | 0.65 |
| Col1a1 | 0.47 | 0.67 |
| Col5a2 | 0.49 | 0.62 |
| Anxa1 | 0.73 | 0.58 |
| Serpinf1 | 0.65 | 0.57 |
| Cilp | 0.76 | 0.54 |
| Adamts4 | 0.65 | 0.94 |
| Ntn1 | 0.62 | 0.86 |
| Ltbp3 | 1 | 1 |
| Col6a2 | 0.24 | 0.67 |
| Ctsc_2 | 0.62 | 0.56 |
| Mmp14 | 0.85 | 0.59 |
| Nid2 | 0.75 | 0.78 |
| Lum | 0.8 | 0.45 |
| S100a6 | 0.4 | 0.52 |
| Thbs2 | 0.18 | 0.38 |
| Col10a1 | 0.86 | 1 |
| Myoc | 0.43 | 0.68 |
| Cela1 | 1 | 0.48 |
| Adamts12 | 1 | 0.39 |

Figure 38:
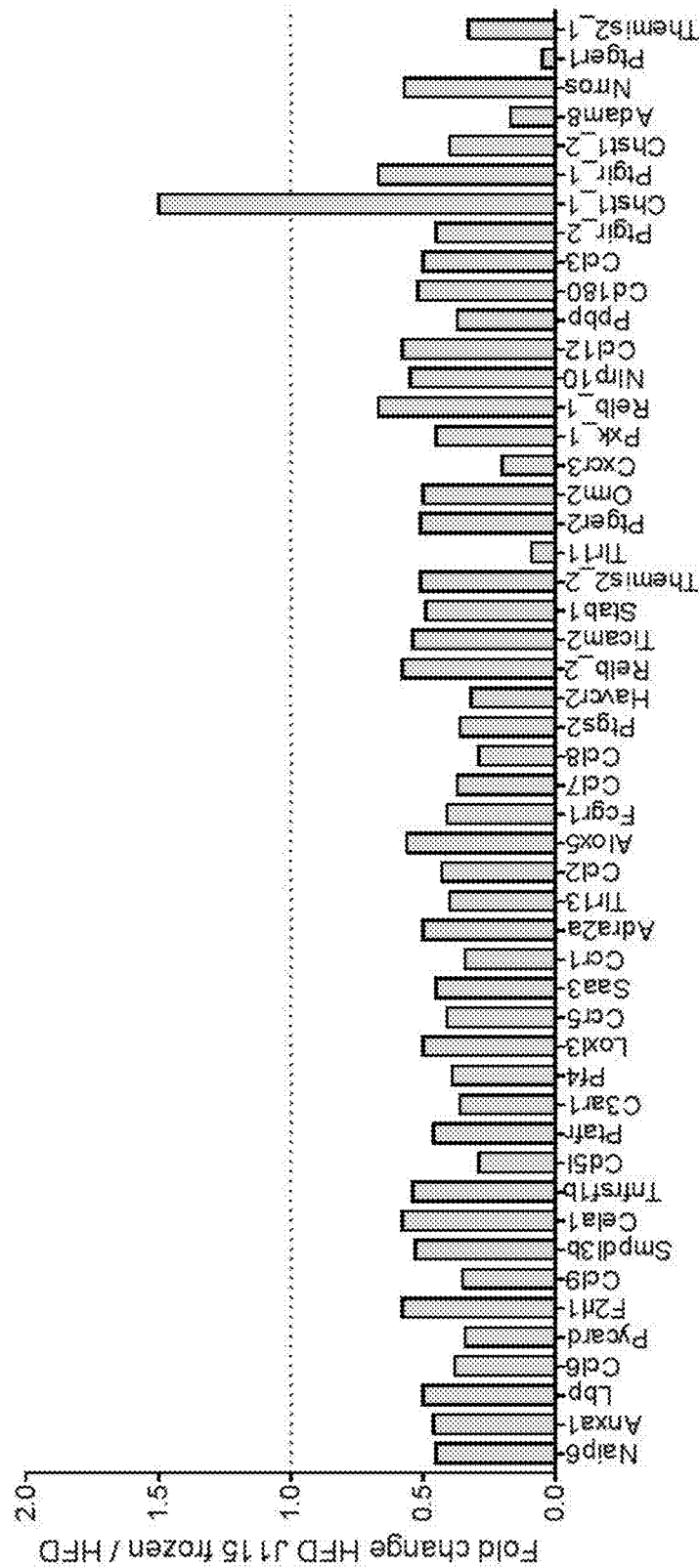
FIG. 38 is a graph obtained from RNAseq analysis in BAT, representing the relative expression of genes belonging to inflammatory response gene ontology group of mice treated by daily oral gavage with frozen suspensions of $5 \cdot 10^9$ cells of *D. welbionis* $J115^T$ and fed a HF-diet relative to mice fed a high-fat diet (HFD) and treated by daily oral gavage with an equivalent volume of sterile trehalose 15% in anaerobic PBS-carbonate buffer saline for 13-weeks (n=12/group). Data are shown as the ratio of expression in treated over expression in untreated mice.
Figure 39:
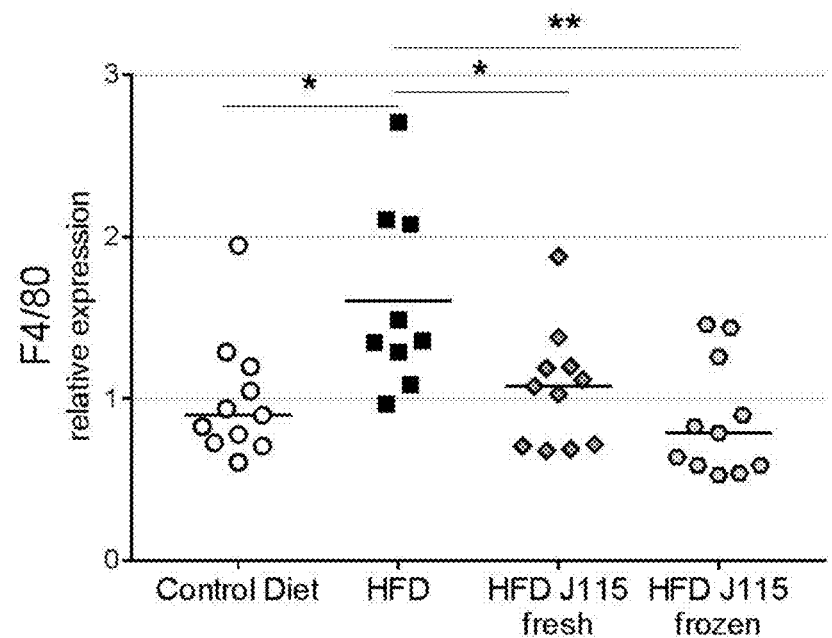
FIG. 39 is a graph obtained from qPCR analysis in BAT, representing the relative expression of F4/80 in mice treated by daily oral gavage with fresh and frozen suspensions of 5·10⁹ cells of *D. welbionis* J115ᵀ and fed a HF-diet (HFD-J115-fresh and HFD-J115-frozen, respectively) or mice fed a control diet (Control) or a high-fat diet (HFD) and treated by daily oral gavage with an equivalent volume of sterile trehalose 15% in anaerobic PBS-carbonate buffer saline for 13-weeks (n=12/group). Data are shown as scatter dot plot with median. Stars indicate significant differences (*: $p<0.05$; **: $p<0.01$) between two groups according to statistical analysis consisting of one-way ANOVA followed by pairwise comparisons and Tukey correction.
Figure 40:
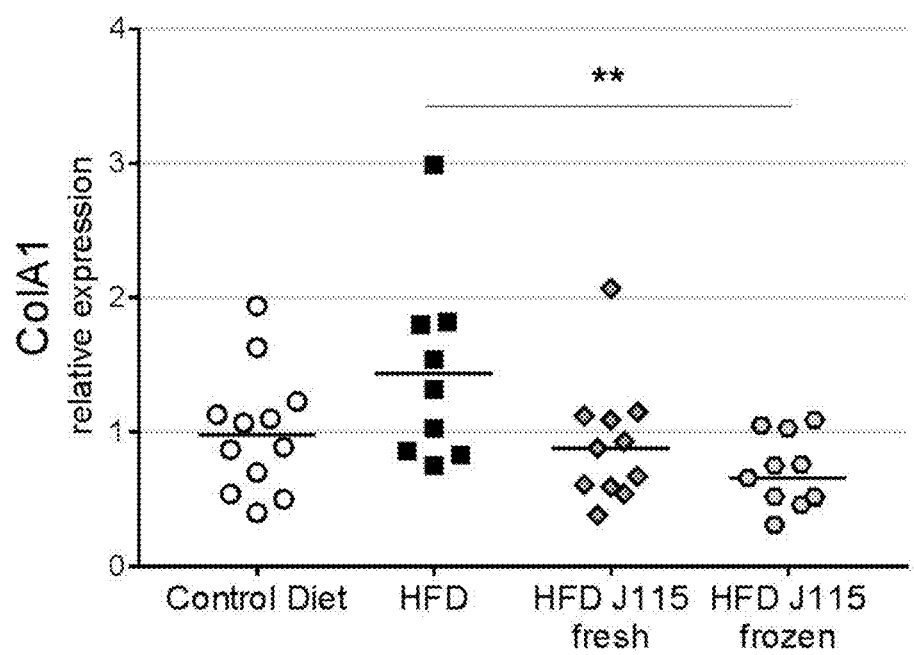
FIG. 40 is a graph obtained from qPCR analysis in BAT, representing the relative expression of ColA1 in mice treated by daily oral gavage with fresh and frozen suspensions of 5·10⁹ cells of *D. welbionis* J115ᵀ and fed a HF-diet (HFD-J115-fresh and HFD-J115-frozen, respectively) or mice fed a control diet (Control) or a high-fat diet (HFD) and treated by daily oral gavage with an equivalent volume of sterile trehalose 15% in anaerobic PBS-carbonate buffer saline for 13-weeks (n=12/group). Data are shown as scatter dot plot with median. Stars indicate significant differences (**: $p<0.01$) between two groups according to statistical analysis consisting of one-way ANOVA followed by pairwise comparisons and Tukey correction.

Accordingly, 50 genes related to inflammatory response gene ontology were all but one down-regulated in the BAT of mice treated with D. welbionis J115$^T$ in comparison with HFD-fed mice, demonstrating that D. welbionis J115$^T$ protects adipose tissue against HFD-induced inflammation and fibrosis (FIG. 38). The relative mRNA expression of two genes related to inflammation (F4/80, a marker of macrophages infiltration) and fibrosis (collagen A1, a constituent of extra-cellular matrix) was also measured by qPCR and it was confirmed that these genes were up-regulated by HFD in comparison with ND and normalized by both fresh and frozen D. welbionis J115$^T$ (FIG. 39 and FIG. 40).

Conclusion

These results indicate that the administration of J115 lead to the amelioration of several deleterious consequences associated with an high fat diet: a decrease of the weight of brown adipose tissues, a decrease of fibrosis in the brown and subcutaneous adipose tissues and a decrease of inflammation in the brown adipose tissue. These observations point to the beneficial effect of the administration of J115 for the treatment of metabolic diseases (notably obesity, adipose tissues inflammation, adipose tissues fibrosis and abnormal fat accumulation, altered lipolysis, high-fat storage). These effects are observed for a daily dose of $5 \cdot 10^9$ J115 cells/mice and are observed over, a range of $3.5 \cdot 10^8$ to $2 \cdot 10^9$ viable/cultivable J115 cells/mice/day. Notably the administration of frozen J115 cells, comprising 7% viable/cultivable cells is as efficient as not frozen preparation comprising 40% viable/cultivable cells. This suggest that not viable J115 cells are also able to ameliorate health in respect to the several deleterious consequences associated with an high fat diet: a decrease of the weight of brown adipose tissues, a decrease of fibrosis in the brown and subcutaneous adipose tissues and a decrease of inflammation in the brown adipose tissue.

Example 11: Effect of D. welbionis Strain J115$^T$ Administration on TLR2 Signaling and the Intestinal Barrier Material and Methods Dysosmobacter welbionis J115$^T$ Cultivation and Enumeration Cf. corresponding section in Example 7.

Mice

Cf. corresponding section in Example 7.

Tissue Sampling

Cf. corresponding section in Example 8.

RNA Preparation, Real-Time qPCR and RNAseq Analysis

RNA preparation, qPCR analyses and were realized as described in corresponding section in Examples 5 and 10. The primer presented in Table 10 below were used for dPCR analysis.

TABLE 10

Nucleotide sequence of the primer pairs used for the measurement of mRNAs expression level by qPCR.

| Primers | Sequence | SEQ ID NO: |
|---|---|---|
| DEFA Forward | GGTGATCATGAGACCCCAGCATCAGT | 15 |
| Reverse | AAGAGACTAAAAGTGAGGAGCAGC | 16 |

In vitro culture and stimulation of human HEK-Blue hTLR2 cell lines.

For the immune receptor stimulation analysis HEK-Blue hTLR2 cell line (Invivogen, CA, USA) was used. Stimulation of the hTLR2 with its ligands activates NFκB, which induces the production of secreted embryonic alkaline phosphatase (SEAP), the levels of which were measured using the QUANTI-Blue colorimetric enzyme assay and a spectrophotometer (Spectramax, Molecular Devices, CA, USA). HEK-Blue hTLR2 cell line was grown and cultured up to 70-80% of confluency using as a maintenance medium DMEM supplemented with 4.5 g/l D-glucose, 50 U/mL penicillin, 50 µg/mL streptomycin, 100 µg/mL Normocin, 2 mM L-glutamine and 10% (v/v) of heat-inactivated FBS. Immune response experiment was carried out by seeding HEK-hTLR2 cells in flat-bottom 96-well plates (50 000 cells per 200 µL well) and stimulating them by addition of 20 µl bacterial suspensions or Pam3CSK4 (synthetic triacylated lipopeptide, Invivogen, CA, USA) as positive control. The 96-well plates were incubated for 24 h at 37° C. in a 5% $CO_2$/95% air atmosphere. SEAP secretion was detected by measuring the OD600 at 1 h after addition of 180 µL of QUANTI-Blue (Invivogen) to 20 µL of induced HEK-Blue hTLR2 supernatant.

Results

Figure 41:
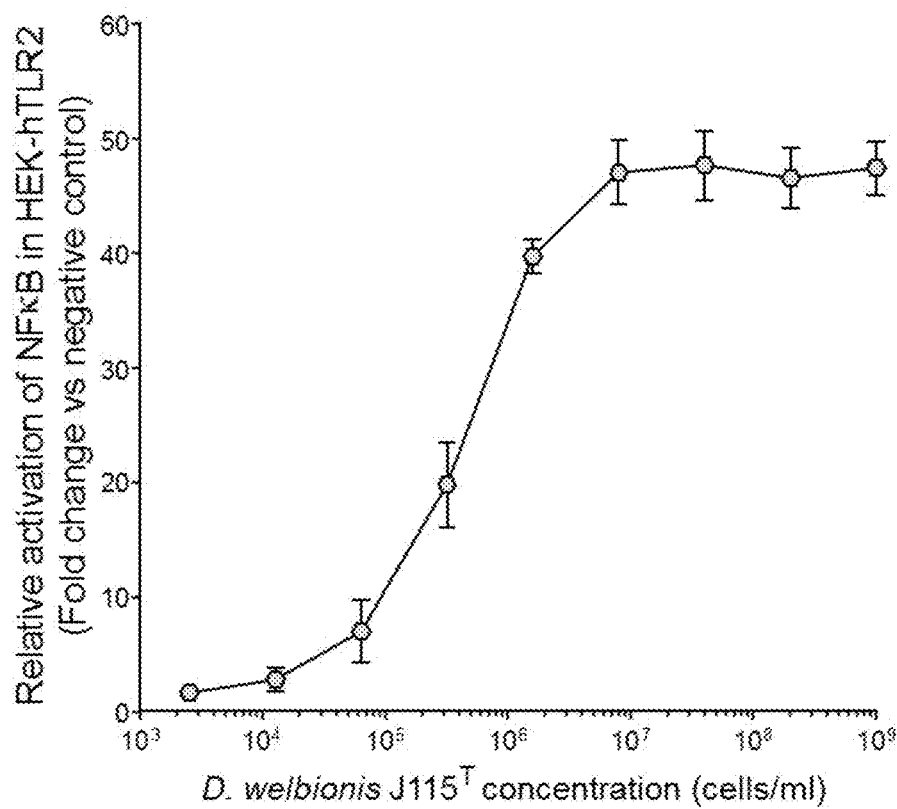
FIG. 41 is a graph showing the stimulation of human HEK-hTLR2 cells by increasing concentration of frozen *D. welbionis* J115ᵀ.
Figure 42:
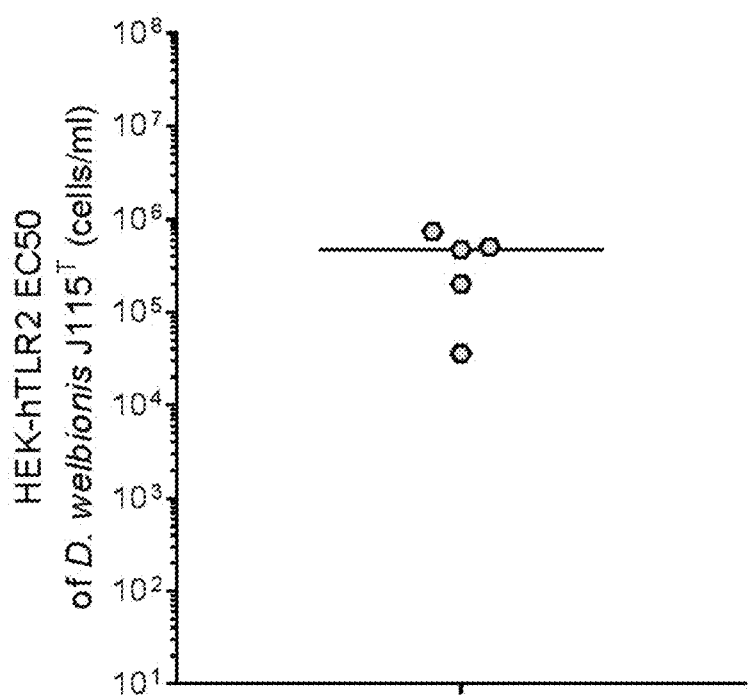
FIG. 42 is a graph showing the effective concentration of frozen *D. welbionis* J115ᵀ necessary to obtain half of the maximal stimulation of human HEK-hTLR2 cells (EC50).

Stimulation of toll-like receptor 2 (TLR2) in the intestine is known to strengthen barrier function and improve metabolic health. Results show that frozen *D. welbionis* $J115^T$ specifically activated cells expressing TLR2 in a dose-dependent manner (FIG. 41). The EC50 is the half-maximal effective concentration and refers to the concentration of bacteria that induces a response halfway between the baseline and maximum after 2 h of exposure. In the case of *D. welbionis* $J115^T$, this EC50 is 3.9 $10^5$ cells per mL, which is a relatively low concentration and indicates that *D. welbionis* $J115^T$ is a strong potent activator of TLR2 (FIG. 42). TLR2 signaling is known to be associated to barrier function strengthening. Indeed, RNAseq analysis in the jejunum showed that the expression of the genes encoding antimicrobial peptides and tight junction proteins was upregulated in the jejunum of mice treated with *D. welbionis* $J115^T$ (Table 11).

TABLE 11

RNAseq analysis in the jejunum, representing the relative expression of genes related to tight junction proteins and antimicrobial peptides of mice treated by daily oral gavage with frozen suspensions of $5.10^9$ cells of *D. welbionis* $J115^T$ and fed a HF-diet relative to mice fed a high-fat diet (HFD) and treated by daily oral gavage with an equivalent volume of sterile trehalose 15% in anaerobic PBS-carbonate buffer saline for 13-weeks (n = 12/group).

| Gene name | Fold-change HFD-J115-frozen/HFD |
|---|---|
| Cldn15 | 1.52 |
| Cldn23 | 1.08 |
| Cldn3 | 1.3 |
| Cldn4 | 2.4 |
| Cldn7 | 1.08 |
| Ocln | 1.06 |
| Muc2 | 1.36 |
| Defa17 | 1.46 |
| Defa2 | 1 |
| Defa20 | 1 |
| Defa21 | 2.5 |
| Defa22 | 2.06 |
| Defa24 | 1.56 |
| Defa30 | 1.33 |
| Defa32 | 1 |
| Defa34 | 2.5 |
| Defa5 | 1.55 |
| Reg1 | 1.54 |
| Reg3a | 1.18 |
| Reg3b | 1.31 |
| Reg3g | 1.73 |

Figure 43:
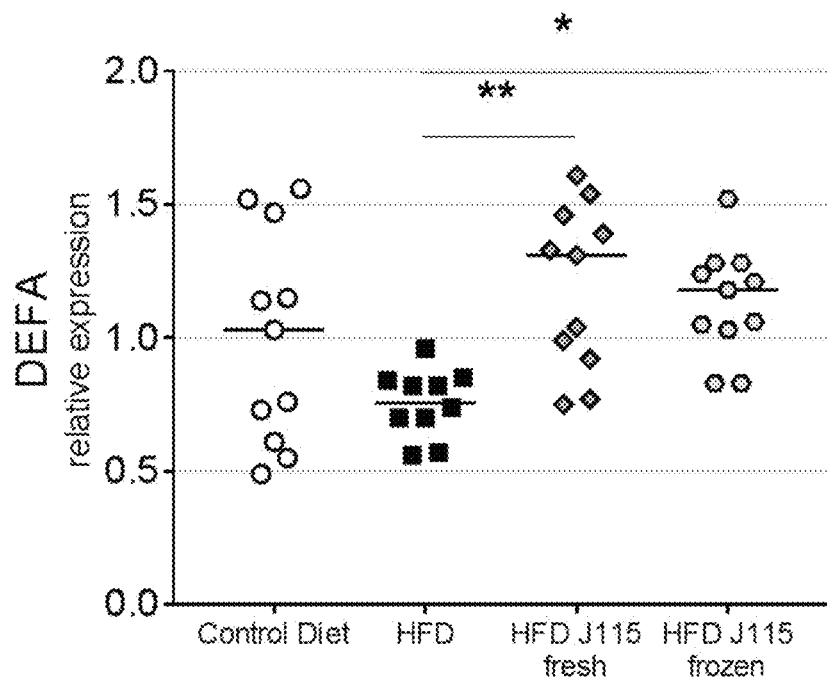
FIG. 43 is a graph obtained from qPCR analysis in the jejunum, representing the relative expression of defensin alpha (DEFA) in mice treated by daily oral gavage with fresh and frozen suspensions of 5·10⁹ cells of *D. welbionis* J115ᵀ and fed a HF-diet (HFD-J115-fresh and HFD-J115-frozen, respectively) or mice fed a control diet (Control) or a high-fat diet (HFD) and treated by daily oral gavage with an equivalent volume of sterile trehalose 15% in anaerobic PBS-carbonate buffer saline for 13-weeks (n=12/group). Data are shown as scatter dot plot with median. Stars indicate significant differences (*: $p<0.05$; **: $p<0.01$) between two groups according to statistical analysis consisting of one-way ANOVA followed by pairwise comparisons and Tukey correction.

The relative mRNA expression of defensin a. was also measured by qPCR and it confirmed that this gene is up-regulated by both fresh and frozen *D. welbionis* $J115^T$ (FIG. 43).

Conclusion

These results indicate that the administration of J115 lead to the amelioration of several deleterious consequences associated with an high fat diet: an increase in the expression of tight junction related genes and an increase in the expression of antimicrobial peptides. Furthermore, J115 is a strong activator of TLR2. The activation of TLR2 promotes anti-inflammatory pathways reinforce the intestinal barrier (Oppong et al., Infect Immun. 2013 February; 81(2):478-86). These observations point to a beneficial effect of the administration of J115 for the treatment of diseases associated with a dysfunctional intestinal barrier notably intestinal inflammation, food allergies, celiac disease, colitis, ulcers, infection, hepatic diseases, steatohepatitis. These effects are observed for a daily dose of $5·10^9$ J115 cells/mice and are observed over a range of $3.5·10^8$ to $2·10^9$ viable/cultivable J115 cells/mice/day. Notably the administration of frozen J115 cells, comprising 7% viable/cultivable cells is as efficient as not frozen preparation comprising 40% viable/cultivable cells. This suggests that not viable J115 cells are also able to ameliorate health in respect to the several deleterious consequences associated with an high fat diet: an increase in the expression of tight junction related genes, an increase in the expression of antimicrobial peptides and an efficient activation of TLR2 signaling.

Example 12: The Proportion of *D. welbionis* in the Human Intestinal Microbiota Correlates Negatively with Weight Material and Methods

*Dysosmobacter* spp quantification in stools by qPCR

Genomic DNA was extracted from human stools using the QIAamp DNA Stool Mini Kit (Qiagen, Germany), including a bead-beating step. DNA concentration was determined and purity (A260/A280) was checked using a NanoDrop2000 (Thermo Fisher Scientific, USA). Samples were diluted to an end concentration of 10 and 0.1 ng/µL in TE buffer pH 8. A standard curve was included on each plate by diluting genomic DNA from pure culture. Cell counts were determined by plating and expressed as cfu before DNA extraction. *Dysosmobacter* spp quantity in stools was expressed as percentage of total bacteria. qPCR was performed as described in example 5 with primers specific for *Dysosmobacter* species and primer allowing amplification from all bacteria (Table 12).

TABLE 12

Nucleotide sequence of the primer pairs used for the Dysosmobacter spp proportion in human stools.

| Primers | | Sequence | SEQ ID NO: |
|---|---|---|---|
| Dysosmo-bacter spp | Forward | ATGACGCATGACGCATGACC | 17 |
| | Reverse | CCAGCGATAAAATCTTTGACATGCC | 18 |
| Total Bacteria | Forward | ACTCCTACGGGAGGCAGCAG | 19 |
| | Reverse | ATTACCGCGGCTGCTGG | 20 |

Results

Figure 44:
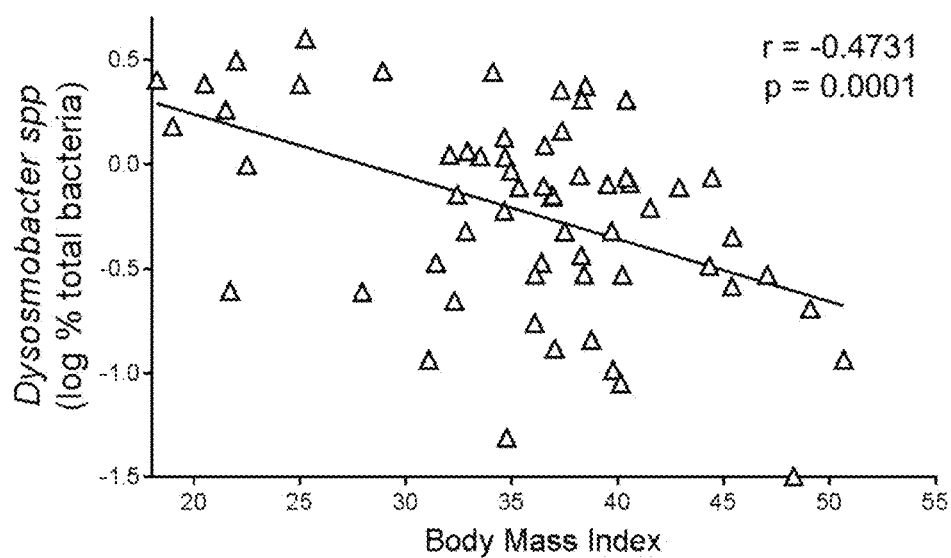
FIG. 44 is a graph showing that faecal *Dysosmobacter* spp relative abundance in correlates negatively with body mass index (BMI) in humans. Pearson correlation between the BMI and the log of *Dysosmobacter* spp relative abundance in stools.

The relative abundance of the genus *Dysosmobacter* in the fecal microbiota of 62 individuals with a body mass index (BMI) ranging from 18.0 to 50.7 kg·m$^{-2}$ was measured by qPCR. Results show that the log of *Dysosmobacter* spp relative abundance was negatively correlated with BMI in this cohort with a p value below 0.0001 (FIG. 44). In conjunction with preclinical data obtained with mouse models, this result confirms that bacteria belonging to the *Dysosmobacter* genus and *D. welbionis* J115$^T$ in particular protect against obesity and contributes to slenderness and metabolic health. In subjects with a BMI bellow 25, the proportion of *Dysosmobacter* was 2.45%. In subjects with a BMI ranging from 25 to 30, the proportion of *Dysosmobacter* was 1.5%. In subjects with a BMI ranging from 30 to 35, the proportion of *Dysosmobacter* was 0.85%. In subjects with a BMI ranging from 35 to 40, the proportion of *Dysosmobacter* was 0.5%.

Conclusion

These observations suggest a positive contribution of the presence of bacteria of the *Dysosmobacter* genus and *D. welbionis* J115$^T$ in particular in the human intestinal microbiota. The negative correlation observed is not limited to obese patient (with a BMI superior to 30) with it is also includes healthy subjects (with a BMI inferior to 30 and with a BMI inferior to 25). These observations again point to the beneficial effect of the administration of J115 for the treatment of metabolic diseases (notably obesity). The correlation being made using healthy subjects also point to the beneficial effect of the administration of J115 in healthy subject to improve well-being and for cosmetic purpose, notably to promote weight loss and/or prevent weight gain.

SEQUENCE LISTING (20 sequences)

SEQ ID NO: 1 - DNA, 1428 bp, Dysosmobacter welbionis
  16S rRNA gene of Dysosmobacter welbionis
cgcggtaattgagtttgatcctggctcaggacgaacgctggcggcgtgcttaacacatgcaagtcgaacggagcacccttgactgaggtttcggccaaatgataggaatgcttagtggcggactggtgagtaacgcgtgaggaacctgccttccagagggggacaacagttggaaacgactgctaataccgcatgacgcatgaccggggcatcccgggcatgtcaaagattttatcgctggaagatggcctcgcgtctgattagctagatggtggggtaacggcccaccatggcgacgatcagtagccggactgagaggttgaccggccacattgggactgagatacggcccagactcctacgggaggcagcagtggggaatattgggcaatggacgcaagtctgacccagcaacgccgcgtgaaggaagaaggctttcgggttgtaaacttcttttgtcagggaagagtagaagacggtacctgacgaataagccacggctaactacgtgccagcagccgcggtaatacgtaggtggcaagcgttgtccggatttactgggtgtaaagggcgtgcagccgggccggcaagtcagatgtgaaatctggaggcttaacctccaaactgcatttgaaactgtaggtcttgagtaccggagaggttatcggaattccttgtgtagcggtgaaatgcgtagatataaggaagaacaccagtggcgaaggcggataactggacggcaactgacggtgaggcgcgaaagcgtggggagcaaacaggattagataccctggtagtccacgctgtaaacgatggatactaggtgtgcggggactgaccccctgcgtgccgcagttaacacaataagtatcccacctggggagtacgatcgcaaggttgaaactcaaaggaattgacgggggcccgcacaagcggtggattatgtggtttaattcgaagcaacgcgaagaaccttaccagggcttgacatcctactaacgaagtagagatacatcaggtgcccttcggggaaagtagagacaggtggtgcatggttgtcgtcagctcgtgtcgtgagatgttgggttaagtcccgcaacgagcgcaacccctattgttagttgctacgcaagagcactctagcgagactgccgttgacaaaacggaggaaggtggggacgacgtcaaatcatcatgccccttatgtcctgggctacacacgtaatacaatggcggtcaacagagggaggcaaagccgcgaggcagagcaaacccccaaaagccgtcccagttcggatcgcaggctgcaacccgcctgcgtgaagtcggaatcgctagtaatcgcggatcagcatgccgcggtgaatacgttcccgggccttgtacacaccgcccgtcacaccatgagagtcgggaacacccgaagtc

SEQ ID NO: 2 - DNA, 20 bp, Artificial Sequence
  universal primer 8F
agagtttgatcctggctcag

SEQ ID NO: 3 - DNA, 19 bp, Artificial Sequence
  universal primer 1492R
ggttaccttgttacgactt

SEQ ID NO: 4 - DNA, 23 bp, Artificial Sequence
  primer RPL-19 fwd
gaaggtcaaagggaatgtgttca

SEQ ID NO: 5 - DNA, 16 bp, Artificial Sequence
  primer RPL-19 rev
cctgttgctcacttgt

SEQ ID NO: 6 - DNA, 16 bp, Artificial Sequence
  primer proglucagon fwd
tggcagcacgcccttc

SEQ ID NO: 7 - DNA, 16 bp, Artificial Sequence
  primer proglucagon rev
gcgcttctgtctggga

SEQ ID NO: 8 - DNA, 19 bp, Artificial Sequence
  primer occludin fwd
atgtccggccgatgctctc

SEQ ID NO: 9 - DNA, 23 bp, Artificial Sequence
  primer occludin rev
tttggctgctcttgggtctgtat

SEQ ID NO: 10 - DNA, 3576111 bp, Dysosmobacter welbionis (residues 1-1,788,056 of 3,576,111)
  genome strain J115 (circular)
atgcgtgagatcctgttgacatcttccgtgctgatcctggcggtcctgctgttgcggcgggccttccgggaccggatttcccgccgggcccagtatgtcctgtgggcgctggtgctggtgcggctgctggtgccggtgagcctgccgggagcggacttctccgtcctgtcggcggcggagccggtgggccggacagtgacggaacggctggaacagcgggaaatttacagagtgccgctggccccctctcccatggggacagcgccccaggtcacatcccccgcacctcagatagagggaggcggctccccctcgggggaggcggccgcgccctccggcggggaggaagccttttcttacccggtcatccgggagcgggtggtgacggcggcggacctgctgacggtcctctggctgatcggcatcgccgccatggcggtgtggtttctggtgaccaacctgcgcttctggcaaaagctccggaggacgagggcgccctatgccgcggagaactgcaggtatcccgtctatctggtggaggcaggtctcccctccccctgcctgttcgggctgttccggcccgccatttatcttacccccgccgttgtcacctctccggagcggctgcggcatgtgctggcccatgagaccgcccacgcccgccatctggacccgttgtggtcgctgctgcggagcgtgtgcctcgcggtgtactggttcgaccctctggtgtggatcgccgccgccgtctccaaggccgacggggagctggcctgcgacgaggccgccatccaggccctgggagagggcgaacgcatcccctacggcaaaacgctgctgtccctgattccggtgcggacgggtcccggctctcccctgctgtccgccaccaccatgacggcagataagcggcagctgaaggaccggatcacccgcatcgcccagggacaacagacccgggcagcggctttgtttctggttctggcgctggcagcgggcgtctgcgccgtcaccttcaccggggccaaggcggatggggaaaccggcggtgtccgctccctcaccggcgacgagctggcgtattttaatgaggagttcttcaatcaggagggtacttacagcatccgcaaccaatttttgaactccctgtacgagaagccggaggacatcgacctctttgagctgttctattgcggcacggggatcgacgcgcctatgaccgatgaggagctgcggcaggtgggcagctttgacaccgcaggggagctgatctgccctgtggacaagatgtccgtggaggccatcaaccaggtgctgctggagaacaccggcctcacgctggaggagacggggcggatcgggatggactacttccagtacctcccggagtatgatgcctactatcacagccacggggataccaactacttctcgggcgtcaacatcactgccggggagcgggtgggcgataccatccggctctactacgacgacacgttccatgttgacggctggaagtgcgtgacactggaagaacaggccgacggctcctactggtttgtctccaaccagcccagtgagcggcccgccatccctaccgtgtacccggaggggagccggtgctgaccattccgctgacagacctcacaccctatgagccggagaccatggaggccattcggcaccggaatgactgcgccgagcgtggcactggctatatcatgcacaccgaggacggcgatgaactctctgtccgcacctatctctccaccgacggcaatctctacgccgccgtgatttatgacgaggcggcgggccgggacgggatgcgcacatgggatgtgggctgcttcttcaccttcccggagcataacacgctgagttacagcgattccggcggctacgccgtctccatggactccttctccgatctgttcggccatgatgggctggtcatccgttactccggcgagctggacgaacatacaggcgccaccttccacgactattactatttcgacaccgagggaaatcccgtcctcctggcccgggtctacggtgacaccgcccagttcgacctggatggcaacggcgcagacgagttgtgtgcctcttcggcaaacaccgcacagatctttttccagcgggatgggcggatctatgaggcggacatcgacgaggatttgaaacaggcttggccggacgcggagtacttgagcttcaaccgttgggacgtgagccgccggaatctggccctgtgggcattcgtccccattcccgacagtccccaggacggcaccgccgaccggtggctgtactttgatggagaaaacctgctggtgtaccgggacggccgtgccacggcggaccacttgatggagggcgcggaagcgccggaggacgtaatggcggtcctgcgggactacgtgcaggagcagtacaccggcgaccatgaggggttgctgttcgtggagggcggcgactttgtccccgccccgctggaatatgacgactggcggattgagtccatcgagggcccctcctatgtatccgtgggcggcctggattttgccatctggagcatgaactatgaactgcacaccaccacgccggagagcgtcattttggccggcggaacgtacatgaccgaggactgctgggtcagccccggttaccccgggtgtgactacttctacttccaactggacgagggcggaacccgcacctatctgtatcaccgcatggagaacgactgcgtccccggaacagagctgtttttctcaggcatggcctaccagctccgggagatggggctgctgtccttctatgacctgacggggcgggagctgctggatatcagctgcagtcagccagtccacttcttcaacacgctgtcggagacgaacctctcggagcagtcccaggcccttgccgccatggcggcctgtgtcgccgccggagacgatcccggcactcaggagatctatgacagcattgcccattatatggaaatcttctccgatgatctgacagacggcggtcgggccgcgtggcaggcgctccagtctgccctgtccatctggacagcggcgggagatggcacggtctatgagagcggcggcctctccctgtgggtgccggagggctgggcagacatggcggcggtcaccgctgaggacgctgtctggttcggagaatctgtgccggggttcgacgtctatgagcgacttgcccacatatcaaatcccgatacaggtctggtctggaatgtccgggccctcacccgtgcccagttccaggccgcctttggggacgcggactggtcggagattttaggggcttccagctatgtgatcggctctgacgacgcctacatctatctgctctccacccccacggacgtgcagttcctggtggaggaccccaccagtatggcccagtatgagctgctgcggaatcagtcccagacggtaatcgagggcttcttcttccgcaacggtatcacccccaacccggactgcccggacgccgacgggtgctatgtgggccccgaagcttcggggcggccggaggtgaacgaggcggccaaggctgctgttcaggcggcgatggacgggattttggcccccggtgccttctccctgaccctctcccccgcccctggtgggtccggcggcggaagctatatactgccgctggatatggcggcggccatctcccggatgccggagaatttcctctggtaccccgcggaggcgggctcgcccccggcgggcctggcctccctgaccctcaccgcagaggacggcagcgccgccctccagtgctgggagggcagctccctggtccgctgcacccggagcggcgtgacacagtggttctacgccccgccggtgacggcggacgcagtcttcaacggcacggtctttgcagccttgcgccagatttatgacgaagtagaatgggaggccctgcgggagggcatcatcatcccggaccggggacagagccatctggagatcgcccaggcctgggccgatgcggatacgcagcccgccctggaggtcacagacggcagcatcttcgcctgcacctatgtgcggactgtggccgatgtggatagctgggcagatatgccggagacctcctatccggagcaatcggaggggcacgagcggttctggttctcctaccggcgcatctttgtaccggagaatgaggcggcccgcagctggcagatggccggcaacaccgtggagtacgacggcaggtacggcgaggccccggagggcgcctatgagaatttccaggtggggtcctctacctgacggatgagggctggcggtgcgacggcaccggcaccggcccgtgaattcggatcaaaaaagagagcggccgaaactccggccgctcttttctgcgctcactgggccaggaacaccaggttccggtccgtgatgaagttggggatactatacacgacgcagatggcgtcgatgccgttctccgccgcgtactgggcggggggcatccggtaataccgcgggtccagcaggtggacctcggcaaagctctgggccaggaagggtgccagggcgtcggagtaggaatcccggatcagcaggagcttgccgccgtctcgggcgttctcattctggatgacgcacaggggttggttgccgcccaggaaggaggcgtatttgtccttctcggtcaaatagctccggtcgtacagtatgccgggttccggagagccggtgcgccaggaggtgaccatgaggccgtcctctttgacccagaattccatggtgtccggcgtcagccagtggatgccggactgggagtacagcgtgccattgaagctggtactggcaatctctggtgtaaagctttcctgctttaatgattctcttcccaggacttccagcagagcattggccccatagaaggccccgagggacgtccagtggtggtctgtgcggtagaagatgggctcgtcggcgtgagcggtcagggcggcggagaagtcgatcatgggcagccccaggcccgccgcctgggagaggtaagcgttctggtcccaggactccgcgccctccggcagtttgtcccgccacacctccgccgcggaggggatcagccccagatacatggggatgtccgacttctccgccagctgggagacgtaattcaggttcgccttctccaggccgtccgcaggggcgtccaccttggagatcaatgtttcgccttcacagagatagatgttgttgaacagccgtttgccgatcagctgctccgtccgggccttcaggcccgtccactggtcccgcaggggaaactggtcctggacgtaggcctccacgtcctccatatagctgccgtccagcacgctggacagagtcagtgccggccgctgctggagggtgcggttctccacgtcggaccgctcccggtccggcaggagcatctgccacaccatcagccccccagaaagaggcagaacaccgctgtgagaaatcttgcgtatcgtttggacaaggtctctgcctcctctcagaaccggaaatacaggaaggggttgtagctgccgtccaccagataggccgtgcagaccaccagggaaaggcccatgagcaccggggtggccagctgttctgcctgccggggcagcttcgcccacagccgctggcccagagcggtggaagccagcaccagtaccgccagtgtcacggcgtagctccgcagccggaacaggtccgccccgctccagagcggcgcaccgccgaaacaggcggcaaggtagtccccgcacacgcccaggtccaccatggcaaagaggccccagcccacgaacaccacgatgagggtgtagaggtgcttgaggatcgccggggtcttctccagtacgccccgaaggacgtaccgctccaagatcagccaggcggcgaagtacagtccccacaggatgaaattccagctggccccgtgccagaagcccgtgcagaaccagacgatcaggaggttccggatggtcctggcggtgccgccccggttgcctcccagggggatatacaaatagtcccggaaccaggaggtcagggacatgtgccaccgccgccagaaggtgcccacggagtcggcgcagtaggggtggtcaaagttctcgttgaaccggaagccgaagatccgccccaggccgatggccatgtcggagtagccggagaaatcgaagtagatctggaagccataggcggcgaggcccagccagccccccagcaccgtcagcgtcccggccccctgagcggcgaggcagtcctcccacagggcgccgatggagttggccagcagcaccttcttggcaagtcccacgcagaaccgccgggcccccagagcgaagttctccgacgtgtggagccggtgccgcaggtccgctgccaccgttttgtactggacgatgggtccggcgatcagctgggggaacatggtgacgaaggcgccgaagtccaccatgttgcgctggaccggtgcgtccttccggtacacgtcgatggtatagctcatggtctggaaggtatagaaagagatgccgatgggcagcgggatgcccagctggggcagatcaatgcccgggatcagggacagattggctgcgatgaagtcccagtacttgaaaaagcccagcagagccaggttgaagatcaccgactgggccacgaaccaccgggcctttttgtcatcactgcggaacttctccaccagcagaccgtgggtgtagtcgatgatgatggagaggaacatgatgacaatgtacaccggttctccccagccgtagaagagcaggctcaccaccagcagcacgaagttccgccacctcagcggcgagagaaagtacaccagcagcgtcagcggcaggtagagaaataaaaatgtcaggctgctgaagaccaccggcgcccctcccctcttctccgtttcacacagccagccgcggcggtgccgcggctggctgcctccttacgcaaagagcgcattgaactgctccgcgatctcctcctgatggtctgccgtggcaatcatggccacataggttccattctggactacctgtgcgttggaccaggtctccatggactccgggtaccaggcgccgccctctgcctgggcgtccacccggtcctgcaggatggaggcggcggtggcagcgtcctcctccgtcccgcactccgccagcacgatctcattcaccacggcgctgatcataggggctttggcgatcagctgcttggtggccacatcggccaggccgggataggagccctccagcatgtcgccctccaagttcatcatcatgatgtcctcttcgccgctggaggcggcgtcctccgcccagccgtactcctccgccagggtgttgtaaaaggccgtcagatccacagtcttgtccgtagtcttgccgccgcaggcggtcagcaggcccatcgtcagcagcgccgacagcgccagggtcaaaaatttcttcatggtgtattgatttcctttctgaatgttctcggggaatacagacggacctctccgctgaaaagttccctctcaccgccagtatttccaattttttttcttttaccatcccatccgccctgcccttgcaattctccgccggaggcggtatcatggctctatcacaaggaaaaaggcgggagatcacaatgtacagtttccgaaacgattacagcgagggcgcccatcccaaggtcctccaggccctggcggacaccaacctccggcagaccgtgggctacggcatggatccctgctgccaagccgcggcggataccatccgccgcctctgcgccgcgccggatgcggcggttcacttcctggtgggcgggacgcaggtgaacctcgttaccatcgacgcgtttctgcagtcctatgaggcggtggttgccgcccagaccggccacgtcagcacccatgagaccggcgccatcgaggccaccggacacaaggtctgcaccgtggagagtcccgacggcaagctgaccccagccctggtcgagtccgttctggcgggccacaacggcacggagcacatggtgctgccccgaatggtgtacatctccgacaccacggagatcggcacggtctacacccgggcggagctggccgccctgcggcagtgctgcgatgttcacggcctgttcctctatctggacggcgcccggctgggctccgccctcacctcccccgacaacgacctgacattgccggacctggccgccctcacccacgccttcaccatcggcggcacgaaaaacggcgccctcttcggggaggcgctggtgctcacccgtcccatgcctcacttccgctggcacatgaagcagcggggcgccgtgctggccaagggccggctgctgggactccagttccaggccctgctggaggacgggctctacttcgacctggcccgccgcgccaacgagctggccttccggctccgggacggcgtcgcggccctgggatatcccttcccggtggcctccccctccaatcagcagttcccggtactgcccaatgagacggtggcaaagctccaggagatgggctatgaatttgagaccgaccacccggtggatgcgaaccacacctgcatccgtctggtgaccagctgggccacgccggagacggcggtggaggacttcctcagggacctggccgggtgctgaacatccaagggaccgccaaacaggcggtccctttttgtgtggtgcttcccgctctgctggcccatgggagctgtcaaactctctcgtgcttttgttcgatttctgcttgacagaaacgtttgttcgagttacaatgcaattagaacaaaagttcgatcaaggaggttttttccatgagcggctggactttcttttttattctggtaggcgtggtctttctgacctctcagctcttccgggtcatcgacgccatcgagcgtcccaaccggcggcatgaccggcggcggacagccctgcggtgagatggacgttctggaaaagctcaccatcctgacggacgcggccaaatacgatgcggcctgcacctccagcggtgggaaccggagggccaaggcggggtatatcggcaataccacctcctctatcgccgggtgctgccactccttctccgccgacgggcgatgcgtgacccttttgaaggtgctgatgaccaaccggtgcgtgtatgactgcaaatactgcgtcaaccgccgcagcaatgaggcgaagcgggccatgttcaccccggaggagctggcggacctcaccatccagttctaccgccggaactacatcgaggggctgttcctctcctccggcgtgtaccgctccccggactataccacggaactgatgatccgggcgctgcggatcttgcgggaagagtaccgcttcaacggctacatccacgccaaggccatccccggcacggctccggagctggtggagcagatggggttcctggcggaccggctcagcgtcaatatcgagctgccgtcagaggcgggacttcggaccctggccccggacaagacgaagcaggccatcctggctcccatggggcagattcgggtgcggggacagcagagccgggaggagctggtgaagtaccgccacgcccccaggttcgcccctgccgggcagagcacccagctgatcgtgggggccacggcggacacggacttccacatcctgcggctgacccaggggctgtatgaccgctaccaactcaaacgggtgttctactccgcctacgtgccggtggtggagcacgccctgttgcccgccaaggacacgaagccgcccctgctgcgggagcaccggctgtatcaggcggactggctgctgcggttttacggcttccgggcggaggagctgctggatgcaagccatccggacttcaacccccaggtggatcccaagtgcagttgggccctccggcacctggacttcttcccggtggaggtgaaccgggcggactacgaggccctgctgcggatccccggcgtgggcgtggtctccgccaagcgcattctggtgtcccgccgggcccggaagctgcggatcgaggatctgcccaagctgggggtggtgatgaagcgggcccagtattttctcaccgcctccggccgcatggcagacggcctgcggttcacaccggacagcctgctgcggaatctgatcgcggcggagcggccctccctgccccaaccggagctggagcagatgtccctgtttgcccctgtgtgagggaggttccccatgaccgagatgatttatgaatacgacggcagctttgagggattcctcacctgcatctttgagagctacgcccaaaaagaagtcctcaccgccatcagctgcggtgaggacattccattcacgttgttccctgtgcggaccgtcctgacggaccgggaccacgccgcacgggtatatcggaaggtggtcaagctgtcgccggaggcggcggacctgctgcgccgcggctttctcacctgcctgccggaccgggaaatgcacctgtaccgtctggtggtgaagctgctggaggaggggccccggttcctccgggatctgtccgatgagacgctgtatcccattctgcgggcggtgcgccacctgaacggtgaggtccaccagtacaagggcttcgtccgcttctccgacctggggggcgtactggggggcgaaatcgagccgaaaaaccgggtcctgcccctgctgcgccgtcacttctgcgaccgctaccggaacgaacggttcttcctctacgaccgtacccaccaggaggccctgttctacgccgagggccgctctgccgtccggcccctggagcacttccagatggccccgccggatgaggcggaggcccgctaccgcctgctgtggaagcgattctacgacaccatcgccatccgggagcgggaaaacccccgctgccgcatgacccacatgcccaagcggtactggggcaccatgacggaattccagggggaagcgcatttcagggcgagaggaactcccgcaaccgtttcaggccccggcgctccagccgggatacctgcacctgagacacccccaggatccgggcagtctgttcctgggtcagtcccttgaagtagcggagaagaatggtcatccgctccttctccggcagctgatcgatggactcccgcagggcgatccgctccaccatgccctcctccggggcgtccgtgcccagcatcccctccagggtgaggccgtctgcggtctcccgctggagggactccggcgtgtccgtggcgatctccacctgggcgatctcctccggcgtcaggccggaggcctcggagagctcgctgagcaccggctcccggcccagctcctgccgcagccgctcccgaatggtgtaaagtgtttgagcctgctcccgcatggtgcgccccacttttaccgcgccgtcgtcccggagaaagcgacgaatctccccggcgattttgggcacggcgtaggtggagaagcaggtgccgtagtcaaagtcgaatccctgcaccgccttcagaaaccccaggcaccccagctggtacaggtcctccgggtccacgccccggccgtaataccgccgcaccacgctccagatcaggccgttgttctcaatcaccgcctgctcgcaggcatcccggtccccctcctgggccgcccgcagcagctccagcgtggcgctcattttgtgccctgcatccggggtgccagccgcttgcgcatcaccacggtggtgccccggcccggcgtggagcggaccaccagcctgtccataaagctctccataatggtgaagcccataccgctgcgctcctccccgccggtggtgaacatgggctggcgggccttctcgatgtccgggatgccccggccgtggtcccgcaccgtcacctccagcacctggtccgggcagatgcggactttcaccaccacctggccgatggaatccggataggcgtggacgatggcgttggtcaccgcctcgctgacggcggtcttgatgtcctccagctcgttgagggtgggatccatctgggcggcgaaacaggacacggctgcccgggcgaacccctcgttgctgctgcggctgggaaatgccagcgtgacttcgttgttggccttggtcttcatggtatgtactcccccttttatcgtatcgtcaccagccggccgatgccggcggcatccaggacccgccgtgcctgctgaggcacgttccgcaccagcaggctcccgtccagcagctgcatccgctgctgggcccgcaggatcagcgcgatgccggagctgtccatgaacgtcacgcccgccaggtccagcaccagttttttcggcagcgccgcgtcgatggacagctccagctcccggagggcgttccgggccccgtggtggtccagctcccccttcatctccagcagcagattccggtccgcgcttgtggcttcgatctccataaagttcccttcttccttgtcgtttgtgtaccaagatacagggtaccccgtttttcctcccattataaggaaacggcccattcttttttgtcggaatcacaccccgccgcaaaatcttcccatttctccgcttgcatcggcacctgcggcggggtatcatgaaggtatctcaagggaaggcaggcatatacatgaaaattttgctgattaatggcagctcccggcccaacggctgcacctacacagccctgcgggagattgctgatacgctggaatccggcggcgcggagacggaaatcctctttctgggcagcggccccgtccgggactgcaccgcctgccggacctgtcagaagacgccgggccgctgcgtgttcgatgacgatatggtgaacccaatcattgagaaggcccgggaggcggacggcttcgtgttcggtacgccggtctattacgcccacccctccggtcgcatcctctccgtgctggaccgggtgttctacgccggaaaagacgccttcgcccacaagcccggcgcggctgttgcctccgcccgcagggcgggcactacggcctctgtagatgtgctggacaaatatttcaccatcgcccagatgccggtagtttcctctacctactggaacatggtccacggcaacacgccggaggaggtgcgccaggacgcggagggaatgcagaccatgcggaatttggcccgaaacctgctctggatggtccagtgcatccaggcgggaaaggccgctggactccagccgccccaggcggagagcgaggcccggaccaacttcatccgctgaagcgcgaaagcccccggaggggatttccctccgggggctttgctgtatttagggctctttcatgtttgctcccacaccatgggcgtgtatcggatgccgtccggggacagctgttcctctgccgtgggagaaaagcccagatggcggtagacctccactgcatagggggagctgtgaaccgtgatccgcccgcggccgccctccgccagatatgcctggaacaggaggcggccgatgccctggcggtgaaacgccgggtctacgaaaaacagggcgatgtggctcccctccgccgccaggactcccaggagctcctgcccctcccaagcgccaaatagtgtcaagtgatttacctgttcaatatctgaaagataagcacgaaatgcctccacgccctccggcggatactccggcgcctcaaattcaaggaacacccgccagcacaggtccatggccgccggaagctcgccaccctgtatgcgtcgaatctccatcgcacacctcattcccccagaagggaccgtacccggtccagcgcctccggcgccgacggcttgatgccgatcacgggtacggtcagccctgccgactccagtgccgcccggagagatgcgataaacacgccccggccgggcagttcccggtcctggtccgaggtggtgttcaccccgcagcagggggagcggtccatacctacgatgcccagcacggcaaatccgtgcttctggtactcccgaatctgccaaaccacctgatccgtcagctcccgcagccgggcagatgcctccggctggcccatggcccggcggatgcgggtgttctctgcctccactggtcgttcccctcctttgggatctccccggtccagccccagacagcacagctccgggcacggcatttgagccacgcttacctgagcatccagaatcagccgcaaaatctcccggtgggcggcaggcacctccgccgtgccgtcggaaatggcgttctgattcagcaggcagtgggccagaaacaccacacgcctgctccttccgtcggtaaacatcccgtctctcctttcatcggcggggacttcccctttctcagcctctcagacatctcagcgcagacagccggtgacgaacttcaagggcacctccatccgcgcggcgatctgctccggcgtcatgccctggtcccggaaccgacggcagacggacttcatattctcacccacctcaatgatgtggcggtccgggtcatagagccgcaccacccgctgcccccagcgatgctccaggggcgggcggacgtacaccacatccgcgcacccaaccaggtgcgccaggaagccgtcgaagtcgtcctcctcaaagtagacctcgctgtcatttgcaccaaagcggatctcctccgcctcttttccaaggaaatccgtccaggtatccagtgtttggaggcacaggccgccggtgagggtcacgttggcaccgaaatccatcaccacatgaagccccaggacctcccggtaaaaggtcttggaccgctccatgtcccggactgccagcaggggatttttcagcttcacaagatcagccctttcttgaaacggattgtgctgccgggcctgacggccgtctggacagcacccttgctctatgataaaattgaaaaaaccatacagggaggattctgcgatggcaatcactgtcaatatctattacacgggcaaccgcggagctgcccggaaattcgcagaggagatgaccgtcagcggcgtcgtggatgcgatccgggcagaggcagggaacctgcggtatgcctatttcttccccatggaggacccggagactgtgctgctgatcgacagctggcgagatcagcaggctttggacacccaccacgcctcccccatgatggcgcagatcgcccggcttcgggagcagtacgacctgcacatgcgggtggagcgatatctgtccgatgagacgccaacaacctctcaggatgaggcgtttatccgcagataactgcaacccccgactgcaagaaaggggcggcggtcagagccgggcctttggtccgggctctgcccgccgcccctgcattctgttttggaacgtggggggtacgttctccttcagccgggacttacgcctgcatggccttggcggattcctccagcttggcgatcagctctttgtacttggcggccttctcccgctcggcgttcaccaccgcctccggggcccgggagacgaacttctcgttggagagcttctgctcgacgccccgcaggccgttctgggctttctcgatctccttgcggatccgctccagttccgcggcgatgtccaccagctcactgaggggcagataagccgtggcattgtgggtgacggcagtcaccatgccggacacatccgccggggcggcgtccgcgaacttcacctcactggcataggccagccgctggatgaagtgcctgccctgggcgtagacgtccggggtggcggtgacgatcagcacctccgccttccgggaagggggcacgttcatctccgcccggcgggcccggatggccttgatggtgtccatgacggcctccattgcggcttcttcctccgggaaggccaggtccgcccggtactcaggccaccgggaggtcatgatgaattgttcctcgtggggcagggcctgatagatctcctccgtgatgaaaggcatgaaggggtgcagcagcttcaaaagctccgttagcacaaagcagagcacattctgggccgccagcttggccccctcgtcctctccctggaggcgggtcttggtgagctcgatataccagtcgcagtaggtatcccacaggaagtcgtagaccttggcggaggccacgccgatctcgtaggcgtccaggttctccgtgacctccttcaccagggtgttcagcttggagaggacccacttgtcctccggcgccagggcgtccgccgcagggagttcacacttgtcgatggtgaggttcatcatcacgaaccggctggcgttccagatcttgttggcgaagttccgcatggcctcgcacttctcggtgtagaaccgggtgtcgttgcccggggagttgccggtgatgaggttgaagcgcagcgcgtcggcaccatacttctccgccatctccagcggatcgatgccgttgcccagggacttggacatcttgcggcccttgtcgtcccgcaccagaccgtggatcagcacggtgtggaaggggatctggtgcatctgctcacagccggagaagatcatccgggccacccagaagaagatgatgtcatagccggtgaccatgacgctggtgggatagtagaagtccagatcagcggtcttttccggccagcccagggtggagaagggccacagggcgctggagaaccaggtgtccagcacgtccgggtcccgggtcagatgggtggagccgcacttttcgcacttggtggggtcctcccgggagacgttgatgtggccgcagtcgtcgcaggtccaggcggggatctggtggccccaccacagctggcgggagatgcaccagtcatggacgttctccatccagttggtgtaggtcttggcgaaccgctcgggcacgaacttcacctcgccctcccggaccacccgcagggcctccttggccaggggctccatcttcacgaaccactgggcggagatcaggggctccacgtcattgtgacagcggtagcaggtgcccacattgtggttgtagggctcggtcttgacgagatagccctgctcctccaggtccttgacgatctgcttgcggcactcgtaccggtccatcccattgtaggggccgccgttctcgttgatcctgccgtcgtcgccgatgcagcggatgacctccaggttatggcgcaggcccacctcgaagtcgttggggtcatgggcgggagtcatcttcacggcgccggtgccgaagcccagctccacgtagtcgtccgccacaatggggatctcccggttcatgatgggcaggatgcaggtcttgcccaccagatcacggaaccgctcgtcctccggattcacagccacgccggtgtcgcccatcatggtctcgggacgggtggtggccaccaccagatcgccgctgccgtcggccaggggatagcggatataccacaggtggccgggcttgtccacatactccacctcggcgtcggacagggcggtgatgcagtgggggcaccagttgatgatgcggcttcccttgtagatcaggcccttgtcatacagctcgcagaaggtctcccgcacagccttggagcagccctcatccatggtgaagcgggagcggctccagtcgcaggagacgcccatcttcttctgctgctccacgatgcggttgccatactcctccttccacttccacacccgctggaggaacttctcccggcccagatcatagcgggtcaggccctccttgacgcgcagttcctcctccaccttgatctgagtggcgatgccggcatggtcggtgccggggacccacagcgtggagtagccctgcatccgcttgaagcgggtcaggatgtcctgcaatgtgcagtccagggcgtggcccatgtggagctggcccgtgacgttgggtggcggcatgacgatggagaagggcttcttcttgggatccggatccccgttaaagcagtcgttgtcctcccacatctggtagatacgggactccacctgttggggttcatacaccttgggcagttctttcatcatacgttcgatctctcctattctctgaactttcgtcctttttgtcatgactggggcgccggtccgcaccgccctgccgttcaccagatcgcagctcagctccagcggaatgctttatgcgcgcttacacagcaaaaacgccctgggcctttcggctcagggcgaacaaatgtccgtggtaccacctggattcgggaaaacccgcactctgcggcgcatttgcgcctgccctgtcaacggtgggcctccgccggggcttactgatgcttcggctccggtgctccgggacgacttctccggcggctttgggagaactcacaccaaccgttctctctcttggccgctgcccaccggatactgcttcccttcctcgcagtttgccatattttattttagtatagtataccccggttcgattgtcaagcgtcagctcagccgcaggatctccttcttcagccgggagatgatgcgcttttccagccgggagatgtagctctgcgagatgcccagctggtccgccacctctttctgggtctgctcttttccgccccccaggccgaaccgcagcgtgatgatctgcttttcccggggcgagagaacgttgatggccgccgccagcaggtcccgctccacatcctcttcgatggggcgcatcaccacgtccgcctcagtccccagcacgtcggagagcagcagctcattgccgtcccagtcggtgttcagcggctcgtcgaaggacacctcccccttccgcccggcatttttgcgcaggtacatcaaaatctcgttctcgatgcaccgggaggcataggtggccagcttgatgttcttgtccgtccggtaggtgcccaccgccttgatgagcccgatggtgccgatggaaatcaggtcctcgatccccactcccgtgttctcgaaccgccgggcaatgtacaccaccagccgcagattatgttcgatcagctccttgcgggcgtcctcctccccgatgcgctccagcagctccgcctcccgctcccggctcaggggcggtggcagggtgtcgctgcccccgatgtagtgcagctccgccggcggcagcagccccacccgcaccagcagccgccgccattgtttcatccagtccttcatggtttcttctccttccagccgtgccgccccacagggcgctgtatcccgtccccagctctgtgggggaaaaggcaaccggcagtccggcataccgctccccgccacctccgtccagtcgctgcgcaccgccagcagcagtccgcccgccactcccaccgcgtggtaggggatcagacggaaccgcagctccggcgccgcccgcatcatgggctccagcagctctgcgggacgctccagcgctccgcggtccagcagagagcggacctctcttggaagcgcaccgtccagccgccccggagacaccaccagcaccggcgctccggagaccggatcccgcagggcgtttcccgtgtcgcagaaagcggtaaacgccgtggtccgcccggccagacacacctgtgcccgcaccagctcgccccggacgccctttcccgccgccgcacgaaacaccactgtcagaaccagataggccgcggccgcagcggtcagcagcacctttgcatccacgtccgtgtagaacacgccgttcaccatcggcacgccgccccccgccaccaggcccagggccagcacgcacccggccatggcacaggagacggcgaacagtagcagcgtcagccgcagcagctttgcctctcctccataggccgccagcgccagcagtatgcctgccgccagcttcaccggcgttgcggagagaaagcccagccccggcagaaataccgccacggcataggcgccccccagcaggcccgccagaaggtagcgtctccgccggaggggaatgcccgccagacgcgcggcgcagagcaccagcagatagtccatcagcgcgttcagcacaaacacgctgtccacatacaccacggtcaagcgatccgcctcccttccgttccgtgggactattatagggcagaccgcagagaaatacggtcgcaaaagggggacgcgccctgtaaaaaggtgcgtccccccggcagccgattggggccgcagcacaaatgctgcggctccggcggcatggaaatactgtgatgggaaataactttacagcaatgataaatacggaacaatcagcgatgccagcatggaaatcaccagaatgaccaccaggatcgcggcaaacagtctgtgcttgttgctcacttgtttccctcctccgtcaggatcttgcggatgctcttttccgccttgctgcggggcagcatcagctcatgcccgcagcccaggcacttgagcttgatgtccatgcccacccgcagaatctcccactgggtgctgccgcagggatgggctttcttcagctccactttgtcatgcagatgcaggtccatattggcctccttgtcaaagcagcctcccgggctgcatatagtaacggtatggaacaacacgccgccgttgcggcagataggatgcgattacaatatgccggaaaacaagctgtatccgccggagggcctgcgccctccctcttctttcacgctccagagcctgcgggaggccatggagcagaacacggtgctggaggatcgggtcctccggtgtgatgccggacacaacctgcttctctccctgggaggcatccaggcccgcattccccgggaggaggtcctctccccctggatcagcggggcccagcgggacatcgccgtcctctcccgggtgggaaagcccgcctgttttctcgtgacggccctccgggccgatgaaaagggcgcgcccacggcactgctctcccgccgggccgttcaggagcgggccatggacttcttcctggagcacctgcgcccaggctccgtggtcactgcggtggtgacgcatctggagtccttcggcgcttttttggatatcggctgcggcatcgtggctatgctgcccatcgagcacatctccgtctcccgcatttcccatccgaaggagcggttccggcccgggcagaagattctggcagccgtccggtccatagaccgggagaagcgccggatcaccatgactcacaaggagctgctgggcacctggatggagaatgccagctggtttcatcccggcgagacagtccggggcgaggtccgcagcgtgaaggagtacggcagcttcatcgagctggcccccaacctctccggcctggcagacgcccgggaggacctgcgcccgggggacggcgtctctgtctacatcaagtccatccgtccggagcggatgaagatcaagctccaggtgatcgaaaagctgccgcccttggcagagccggagccgctgcgctatcagatcaccgacggggtactggaccggtgggtctactcccctgccgggtatgagaagccggccgtggagacggtgttcacggctgaggacccttgatctcgtcccagtagtgcttggcggcctgctccgtcttgttatcgccgtattcgtagtaatggacacccttcagggcatcgggcagatactgctgctgtacccagtggcggggaaagtcgtgggggtacaggtagccctgctcccgctccataccggcggagtccgcgtgaacgttctgcagttcccggggcacgtccccggtgcggcctgccctcacgtctgcccaggccctgccgataccggctgtcacgctgttggacttgggggccgtggccagcaggatagccgcctgggccaggggcagctgggcctccggcagccccagctgcatggcagtatccacacatgccttcacaatggagaccgcctgggggtacgccatccccacatcctcgctggcggagcacagcagccgccggcagggggtgatgaggtcccccgcctccagaaagcgggccaggtagtggagcgccgcatccgggtcgctgccccggagggacttcatcagggcggaggcggcgtcgtacatggcgtcgccgcctctgtcgtaccgcatggcgctgcgctgggccacctgctccacgtcgtccagggtcagcatcagcttcccatctctgggcatggctgcccggcacagaagttccaccgcattgatggccttgcggacgtcgccgccgcaagcggtggcgatctgccggggcacatcctgctcccagtccaggggcagaggcgaacggtcctgctcgatcttcagtgcccgcaggacagcgggttccacctcctccggcgacacggccttgaactcaaacaccgtgctgcgggacagcagggctccgtacacataaaagtacgggttctccgtggtggaggcgatgagggtcaaagagccgttctccatgaattccagcaggctctgctgctgcttcttattgaagtactgaatctcgtccaggtacagcagaatgccccctggggccagcagcgtccccacgtcggcaatgatgtccttcacgtcctgcaaggatgcggtggtggcgttgagccggtggagggtcttattggtctgccgggcgatgatgttggcgatggtggtctttccggtgccggaggggccgtagaacaccatattcgcctccgtgccgctgtcgatcagccgccggagcacggcgccgggggagagcagatgccgctggcccaccacctcgtccaatgttttggggcggatctcatccgcaagaggccgctgcatggcggcacccccttccctgttgatctcggaacattcattatagcatggcccattggaaatttccaccgggaaaacgccaaaaagccgggaagacagtccgtcctcccggctttcggcctgtaaactcagccaacggtcttccagtgcttgtccacgtggttcaaaatctcgcagccgtcctccgtcaccagcactaggtcctccacccggacaccgaattcgccgggcagatacacgccgggctcaatggagaagatcatacccggcttggccagggtggtgttggtggcgctgacgtcgcccttctcatgctccgtctggccgatgaagtggcccagccggtgggtgaagtattctccgtatccggcggcggagatgtggtcccgtgcggccttgtccaggtcgcacaggggcacgccgggccgcagcatggactccgccagctcgttggcctcccgcaccaggtcgtggatggcggcgtacttgggatccgccgccctgcagaagaaggtccgggtcatgtcggagcagtagcggttcttccggcagcccatgtcaatgacgatgcagtccccagccttcaggcgggtctggtccgcctcgtggtgggggtccgcggcgtgggcgccgtaggagacgatgggcaggaacgcagtggagtcacagccctcggcggcatactgggccacgatgtagtcggccacctcccgctcggtcatgccctctttcatgtaggcggcagcccgctccatcaccacgtcgttgatgcgggaggcctcccgcatcaggtcccgctccaccgcgtccttgcaggcccgggcgtcgtccacgcagtcggaggccagcacatacttgcagctgggattgtgggccatcaggggcagcagaaaccgggcgggccagtccttgtccacgcccatgtctttttccccgtccacggcatttgccagaatggcgagatagtcgtccgtgtcggagaaccacacctgctcatagggtgcctccggcaccgggaacagtttgttcagaaataacttgtgctgtccgtccttccgcaggtaaaaggcgtacagccgttcaaacgggaacacatcgtaccctgtcagataccagatgctgtccggatcggacacgagcatctgctccaggcccatccgttccatggcggccagtacgcggctgattcgctcctgatacatgatgtcacccctctttttttccgataatggtctccaccagctccggagagaccagagcctttacggtcttgacgccggttttcagggactctaccggcgcatactcgtaccggccgtgggcgttgtggcccgcgctgggcaggttggggcacagcaggcccttgtaggtcagcacactgccgtcagtgccgccccggatgggagaatgggtggggtgctcaatgccggcggccttcatggcggactctgccagctccagaatctccatgtggtccttcagcacctcgtacatattgtagtactggtcgtgggtgtccaccaccgcggtgccgtcgccccagcggcggttgatctgctccgcggccttgtccatcatggccttgcgctcctgaaaccgcttcatgtcgtggtcccggacgatatactccatcgtggccttctccgccttgccgtgcatctcctgcagatggaagaagccctcgtacccctccgtgtgggcgggggtctccagcgccggcagcagggcgttgtactccatggcgatcaacagggcgttgcgcatcttgtccttggaggtgcccgggtggatgctgaagccgttgatggtcaccacggtcttggcggcgttgaaggtctcgtactcatagtcggtgatatcgccgccgtccagggtataggcaaagtccgcgccgaagccggatacatcgaagaagctggcgcccatgccgatctcctcgtccggggtgaagcccaggcagattttgccgtggggagccttctctgccagcagctcctccaccgcctgaaggatgatggcgatgcccgccttgtcatccgcccccagcagggtggtgccatcggtgcagaccagctcctgacccacgaatttctgcagctccgggaactgggcggcctccatgacgatgttctgctcccggttcagcaccacgtccccgccggtgtagtggatgatctggggtttcacgtccttgccggtcatgtccggggtggtgtccatgtgggcgatcaggccgatggcgggcagctgttcgcaccccggcgtggcatccagggtggcgtagacgtagcacttgtcatcgtaccgggcgttttcgatgccaaggccgtggagctcctctaccagcagcttggccatgtcgaactggcggtccgtgctgggggtgacagtgcggccggcgtggtagtcactctcgctgtacaccttggcgtagcggatcaggcggtcaacaacggtatccatgttctagattcctccttattcttccttggagagcagattctccggattcaggcatttcaattcgtccagcacgaagaggccgtccttgcggatcagcacgtcatcgaaccagatctcgcccccgccgtactccggcgtctggatctggatcaggtcccaatggacggcggaatggttgccgttggaggcattgtcgtagctgttgccgggggtcaggtggaagctgccggcgatcttctcgtcgaacagaatgtccccgatggggtggttgatctccgggttcacaccgaaggcgaactcgccgatgtaccgggcgccctcgtcgatgtccaggatctcgttcatatagtccgtgttgttgctggtggccttgacgatcttgccgtccttgaactccagatacacgtcccggaacaaaaagccgtcatagggggacggcacgttgtaggtgatgtgcccgttgacggagttcttcacgggcgaggtgtagatctcgccgtcggggatgttccggttgccgtgcatcccgaagctggggatgcccttgatggagaaggagatgtccgtgccgggagcgacgatgcgaaccttgtcagtcctggccatcaggtcctggaggggctgcatggcccggcccatcttgtcgtagtccaccaggcaggcccggaaatagaagtcctcatactcttccgtggaaacgcccgccagctgggccatggcatcgttggggtaccggagcacggaccacttggtatggttgcaccgctccgccagatggatggggccccagtaatactggcggtagcgcttctgggcctcgtcgctgacgttgtgccacatgctgatattggtggtggcccgaatgtcgatataggcgtccatgtcccgcatccgctccagctcgtaggaggcgatctcctccatgtgctccgcgtcggctccctggaccagggcaccctccacggcgtagtcgaagatgtggacaaagggcttgccgcccacagcataggcttcctggaccagggacttcatcaatccggtctcactgccgtggagctcaatcaggatcttctcgcccttctccaggcccacagcgctgcggatcaggaactgggcgaatttgcggatacggggatcttccatggtggttcctctctttcctttcagtccttgcgcgtcaccgcacagaaaaaacggggcagaagagcatctcttctgccccgcctggaatcagttgtcctggtacagggcttccagagaccgcttgggatcgttgcagcgggtcacggcgctgacgatcagtatggcaatcaccgaggcaggcaccgccacaatggcgcactggatgccgtagggcgtgcccatcagcgtccagatgatcgtgaccagaccgcccaccaggataccggccatgccgccggcgggcgtcaccttcttggagaagagggcgaacaggatcgccggggtgatggcggcgccgtacatggtgtaggccgtcatctgcagggacagcacagtggggaaatacagcgtcagcgccacagcgatgaagctgaacacaatgatggtaccccggaggaccagcatcttctgcttgtcggtggcatccttgcggatgtactttacatagatgtcgttggtcaggttggtggcagaggagagcagatagctgtccgccgtggtgacgatgaaggccatgcaggcgcacatcaccagcgcaccgaaggccagaggcaggtagtccaccgctacctggaagatcacattggagggaacgtccagggtgggatacagcttggctgcctgggtgactaccaggacaatgctgatgatgaccaggatctcgccgatgaacatgccgatgttggacttcttggcctcgtcgctgtttttggcagaggcgaaccgctgcagcatgttctggtcgcccagcatcagggccagggagggcaggaagtagcccagcagctcccagccggacataccgccggtaatggtcatcttctccggaggcagagtggcgccctgagagttggccacgccgatcaggaagggaatcgccaggaagaagccgccgatcatcagcagggcgctgatggcgtcggaataggccacagacaccagaccgccgcccacggtgatgatggcgatcagggctgtgcagatggtcagggccaagccgtgggagatctcaatcccgctggaagcgcacagcagcacgatgatgtccgccgcagccttcagctgggtggccagcacgcccacataggccagcatgacgcacagggcggcgatgatgctggcggccttgccgtaacgggcgcccatgatctccggcaccgtgaccttgttggacttgcggaccttgccggcgatgaaatacagcaggatgatgccgatgggcggcgccgcaaaggtgatgagacccacccaggggccgccggtgtacaccacgctggcggagccggtgattccgccgccgccgcaccaagtagcaagcagtgtgcccaccaggatgatgaaggggatccggtggccgccggtcaccatgtcatccgaggtcttgactttcttccgggccacgatcagcccgaagatcgtgagcagcaccagataggcgctgatcgcaacaatgtaagtcatatattctccttctcctcacacaatagaataataaagagattttactctttcaggggaataatgtcaagttgtatcccgtccggcgtatgcgccggcatccggacgcggcaatttttctctggctttttgtcgaaatctgtggtatcctgtccccgaggtgagcgacatgacatccaaggctgcggtgaaccgcatcattgagacactgaagggcatttacccggacgggctgtgctccttacaatataaaaaggactacgagttgctgtttgcggtgcgcctgtccgcccagtgcacagacgagcgggtgaacaaggtgaccccggcgctgtacgcccgcttccctaccctggaaagttttgccgaggcggatccggcggaggtgggagaatacatccactcctgcggcttttacaacggcaaggcccgggacatcgtggcctgtgcccagaagctggtgaatgaatacggcggcagagtccccggcaccatggaagaactgaccggccttcccggcgtggggcgcaagaccgccaatctgattctgggggacgtgttcggccagcccgcctatgtctgcgacacccactgcatccgcatcacgggacggctggggatcaccgacggctccaaagatccccttcaggtggagcggcagctgcgggagcggatccctcccaaggagtccaacaacttctgccaccggatggtgctcttcggccgggatacctgcaccgcccgctcccccaagtgcgagggctgccccctggcaaaggactgcgacaccgccaaagccgccagacggggctgacagcattggaatcactctggaacttcacgtgtctgcgcaatgcgcaggcacgtttttttgtcttccctcatatactgagatgaaatccatccgacagacggcacaaggaggcactatggacgaacagacggcccgtatgatccaacagctgaaaagcaaccccgccatgctccaggcgctgatgcagtcccgggacgggcaggcgctgatgcagatgctctccgggggagaccgtggagcatctctccagcgggcggcccagtccgccgccaagggcaacccggcggagatggtccgcatggtgaaccagctgatgcagagcccggacggcgcagctttgatcgaccgcatcaacaagaccatgaacggccggtaacggcaagtacagaaagggggcggaccggcggtggcggaattcgacgataaactgaacagcattctctccaacccggacgccatggcacagatcatgcaactggcccagtctctctccggtgggaccggaggaaacaacgccgccaatgcgccgccccctcccccgtcccagccgggcggttcttctcccggctggggccagcagccgcagactccgccgccatccggcggcgatcctctctccgccctggccggtgggctggatccgcagctgctcctgcggttcctgcccctgatccaggagctgggaggagcacgggactccaacgcccggcagctgctgtacgcactgcggccctatctcaagccggagcggcaggagaaggtggaacgggctctccagctggcgcgcctgttccacctgggccggaaatttctggctggatgggaggggtgagacatgtataaccgctacatccgcaacgaccagggcacctacacccgtatcccggaggaggagccccggcatacacagggcggcacctccccttccggtcagccggaacacccgccatccggcggcgggcagcagcctccccattgggacagcgcccccccgccccgccctgatcctcccccctccggcgagaatgggccggacagcctcagcagcctgctccggcatctgctggaccagtttcacctgagcagtgtggattccggggacctgctgctgttggccatcctcttcttcctcttccgggagggcgcggatgaagagctgctggtggccctgggcctgctgctgatcttgtaaatgacagaaaaaacacgccgcaagcattctgtgcttgcggcgtgtggcgcagaaggagggatttgaaccctcgcggcgttttttagacaccctactcccttagcaggggagccccttcggcctcttgggtacttctgcagatacgatattcactgattaaagatgtggcggagagagtgggattcgaacccacggacgcttgcgcgtcgccggttttcaagaccggttccttcaaccgctcggacatctctccatcatggaaaggcgccatccgtcggacgcctgattattatactatatcgattggcgatttgtcaacaatctgctcccatttttatttttttaatttttttcattttaggggttgcatttccagaaacagtatgctattataactgagctgacttcgagcagcacatttccgggtgtggcgcagttggtagcgcgcttgactgggggtcaagaggccgtgagttcaagtctcgccactcggaccaatcgaagcatccaatttggatgcttcgattttttttactttcaccgacatctcccctggcttgtttgtgactggccgcacacattgcccgctcggcaatgtgtgcggccttattgttcagaatataccggcggaaacaaacacagcatccatgttgtacagattgcggcgggcgtcttctgattcgcagtcccccctgctcttccgctgccgacctagctgtccggagattgcatgccatgaccggccatctaaagatttccccattttgaaacttttttcgacaaaccggcgtctattaggtagagcagaaccaaaagcaacagatcacataggctcccgaggaggactcccatggtttatacaaatgatagagccgcagacgtacatagctcaaaagggcggcgtagaaagcgctcccgcagactgcgctggcctttgaagcttttctgcatgtgtctggtattgtctgccgtggttttgactatacgcacagtgagatccttttccgcccccatgtctgcgttggagcctgcggaacaactgacggagcagcacccggagtcttcgctgcaggaacccgatgccctgccgccggtcgagctgaatccggccccccagtccggcgccgttactccggatgactggcagatcctgctggtgaaccgctggaaccctttgcccgatggatacacgtttgaacggacaaagctgaagtatggccactcggtggattccagagcatacccggatctgcaggagatgatggacgactgccgggcagcgggattggacccggtgatctgctcgtcctaccggacacaggccaagcagcaggagctgtacgaaaacaagctccagcgtttgatagaagagggatattcatacgaaaacgccgtcacggaggctggaactgtggtagccgtaccgggcaccagtgagcaccagacgggcctggccctggacattgtagacgcctcctatcagattttggaccaggggcaggaggacaccctggtccagcagtggctgatcgagcacagctgggaatacggttttgtcctgcgctatcccaacgccaaaagcgagatcacaggcattatctatgagccctggcactaccgctatgtgggccgggaagccgcccgggagatgacggagcttgacctgtgcctggaggaatacgtggactggctctccgcccagtgagccatcgtatatatgcaaacgacgccttggacatcgtatctgtccaaggcgctgttttgtcatggttcgtcgtgctcactgccgtctggccgtgcggtaatcgtcgccgggccggtagaagggacagtcccgtgtgccgccacggagaaaccgctccatttcgtcctcgtccaggtccgcttcgcagacgtaagccgccagttcctcgtcgtagtcgtagtagacacactcctcgcaatttgccgacatgctctctcctcctcacagcaggacggcgtacaggccgtccacgtccagtctttcccggatcaccagggcctccagatccgcccgggccgacggcggcgcagaccagcacatcccgcagccggcggtgatgctccggggcaccggaatcagccgccccggcagccccgccgcctggcaggcccgctccatggccatggccccggtggtggtggcgaaagttaccacgaaccgctcctcttttttccgcatggtcagactgcctccgccgccaggatacggaccgcctctgcagccgcgtcggtctctgcctctgtattgaaataggaccaggagaaccgcaccgcgccctggtcctcggtccccagcgcccggtggagccggggggcgcagtgggcgccgggccgggtggcgatctcaaaccgctccgccagctcgtccgccacctccgaggagtccagatcagcgatattcagggacacgataggcgcccggagctgtacagcaaaattcccatacacttttacgccaggaatggttctaacggtttcatagaaccgccgggacaggacggactcgtgcatgcggactgcgtcccaaccggtacgcttcagaaacgccaaagatgctcccaggccggcaataccatggctgttgagggtccccgcctccagccgggtgggataggcctccggctgggtctcagagtagctctggacgccggtgccgcccacggcaaaggggcgaatctccacccccgctcccacacagagcccgccggtgccctgggggcccatcaggcttttgtggccggtgaagcacaccacgctgatgtgctgccgttccatgtcaatgggaaatacccctgcggtctgggaggcatccagaatgaacagaagcctgtgcttctggcagaagttccccacccgctggatgtccatcagatcccccgtcaggttggagccgtgggtgcacaccactgcctttgtattcggccgcaggagccgctcaaagtcctcgtagtcaatccgcccctgccggtctgccgggacgaagtccaccgcccctccctgcgcccgcagtctgtacagcggacgcagaaccgagttatgctccagatctgtggagatcacatggtcccccgcccccagcaggccggagatggcgatgttcagcgccatggtggaattgggcgtgaaggccacacggtccgcccgggaacagccgaagagagccgccagcgcctgacggacgccgtagatgctccgggccgcctccagggcctccggatgggtgccccggccgctgttgccgtagtcattcatggccgcggccaccgcctctgccacactgggaggcttgggccgggtggtggcggcgttgtccaggtagatcatggcttgatgaccttcccggcattggccagggcctccacaatggcgtacatattcgtgacgccgcccacagccagcttctccgccagaccgtaaaagttcaggcaggtgccgcaggtgaggatctccactccctgggcctccatattccgcaggtcctccagagattcggaaccctccaccgtcagcttggcaccgccgttatagaacaggacggtcctgggcagccggggcagctggctcacggcaaaaaggaagctcttcatcagcagcttccccagttcgtcgctgccccgtcccatagtctctgaatccacggccaccaccaagtcgccccgggcgtccggaacacaggtcagagcaggttcctccgccggggcatctcccaccggctccgccacttccatggtcaccacaaacaggtgctctcccttcttctccgcctggaccggcaggtggttccccgccgccatgcgggtcaggttctgcaccgcgatctcattgtccacccggacctccagcgttcccggctctcccagctcccgcagggctttcgtggccttcaccaccggaacggggcacggctcccccacagcgtccacgatcacagttttcatcttgttctcctctccccgcccctcggcggctgtgtgttttatccgttcgcctgcggcaggacggaggatttagagcccgtccccaggcgatctttccggccgcataccgctcgaccaccagcctaacgctgcccgcgcgcacagaatcatcatccggaccggcagggacagttccgctgcggagcggttgccgctccttctaggcgggacggcactctacggccattgtatcgtctctttcctggaaaagcaagggatgttttttgaaaagaacatcgctctgcctgtctgtttgggaaaatcaaggactgtttttccgttttttgggcaaatttcttgacagagacatggatgtgctcgtaaaataggacacatctatagcaccgcaaaattcgacgcggtagagtttatgaagatttgaggctgttgatatgaagaccccctttgtcacaaaggaccagctggaggccatcgccgcccagtaccccaccccgttccacatctatgatgagcagggcatccgggagaatgcccgccgcctgcggaaggcatttgcctggaatcccggctaccgggagtatttcgccgtgaaggccgctcccacccctgccctgctgaagctgctgcacgaggagggctgcggctgcgactgttcctccatgacggagctgataatctcggagcggtgcggcatcaccggtgagaacatcatgttctcctccaacgataccccggcggaggaattccagatggcggaccggctgggcgccatcatcaacctggacgatctgacgctggtggactatctggagcggtccatcggccatgtgccggagaaaatctgctgccgctacaatcccggcggcgtgttcaccctgggcgagacccgggagggcttccaggtgatggacaatcccggcgacgccaagtacggcatgacccgcgcccagatcgcggaggcatttacccgcctttccgccatgggcgccaaggagttcggcatccacgccttcctggcctccaacaccctgtctaacgactactaccccgccctcgcccgcattctcttccagctggcagcggagctgaaggcggagaccggcgtccatatcaccttcatcaacctctccggcggcgtggggatcccctaccgtccggagcagcctgccaatgatatcgccgtcatcggcgagggagtccgccgggcctatgaggaggtgctggtgcccgccgggatgggtgacgtggccctgtataccgagctgggccgcttcatgaccggtccgtacgggcatctggtcacccgggccatccacgaaaagcacatctataaggagtacatcggcgtggatgcctgtgcctgcaacctgatgcgtccggccatgtacgggtcctaccaccatatcaccgtgatgggcaaggaggaccagctctgcgaccataagtatgacatcgccggcagcctctgcgagaacaatgacaagttcgccgtggaccggatgctgcccaagatcgacatgggggacctgctggtgatccacgacaccggcgcccacggcttctccatgggctacaactacaatggcaagctccgctccgccgagctgctgctgaaggaggacggctccgtggagctgatccgccgggcggagacgccggaggactatttccgcacattggtctggtgaggaaaccgcccagtcccgcagcaacggatcaaaatcaaaagcgccaccgcaggagcggtggcgctttttctgtttttgtcaggcggaggcacctgtctggtcttcagcagtgaagtagacgaagaaagtctcgccggtgctctcctccccggagtcatccacaaactgctccagataagcgatggagaagtccgtaaaaccggagggtacctcatagaccagttcgccgctgcgctcctcgtccacggccatgggatatgtaccgggcagctggttctcccccaccggctccacttccgtataggtctccatgtctgtggtgatgggataggcataggcgtcatcgccgtcgtcccactggacctggaaatcagtgtcatacatctcaatgctctgctcgaaggtgttctttacggtgatgtccgccaccagcagtacgttcccctccccaggggtacggcccgcgtagtcgctggtaaggtatgcgctgttgactgtgaaatcaaagaagtaggtctccatggtgtcgccggtgcggccctcgctggagccgcttccgccgcaggcggtcagccccagtgccatcaccacagccgccgccaatgcaaacagtctctgtttcatttcactctctcccttgccaaaaaatagatccgggcctccgccgcccccggcagaacgccccacgaccaatctcagtgtaccatggcgcccagccgggcgcaactgccgttcaaaaaaatttttctcagcgcgggggcttccctttgtgcacctttatcgggtggggatgatctcgatccagtatccgtcgggatctgtcacaaaatagatccccatggcaggattctcaaagcagatgcagcccatggcggcatgcttggcgtgggccgcctcatagtcctctgcccggagggccagatggaattcgcactcccccaggtcatacttctggggatggtcccgcagccatgtcagctccaggcggaagtccgtttttccatcccccaggtagacgatgatgaagctgccgtcggccgccgccttccgctcccccaccggctccaggcccagggcctccttgtagaacgcaagagatttgtccaaatccgctacattgaaattgaagtgattgaatgtcagcataagctcctcctgatcgccgggggccctctgcctccggcttggtttgggttcagtatagcatttctgccccctccggggcaaggccctttccaaaccctgcccgccgcttcttctttttatccatgttatacaatttccagagaaaaatttgtcggcttttggcttgttttatagttgcctcctaaagtgcacgatgataaacttctaattgttagacaatgctaacttttgaggaggaacgttccgatgacactggacaagctgcccctggggcaggaggccgtcatcacggctgtgggcggcgagggcgccctgcgctgccgcctgctggatatggggctgatcccgaagacccgcgtgcgggtggagaaggtcgcacccctgggcgacccgttggagctgcgggtgcgggggtactccctgtccctgcggaaggaggacgccgggaaaatcgaagtggaggtggccgggacatgattttcgcactggccggcaaccaaaactgcggcaagaccacgctgttcaaccagctcaccggctccaaccagcacgtgggcaatttccccggcgtgacggtggatcagaagtctggcgccatccggggggaaaaggactgcacggtggtcgacctgccgggcatctactccatccggccctatacgccggaggagattgtcacccgggatttcatcctgaaccaaaagcccgacggcctcattaatatcgtggacgccaccaatatcgagcggaacctgtacctgacgctccagctgatggagatgcgtattcccatggtactggccctaaacatgatggatgaggtcaccgccggcggcggcaccatcgacgtgaagggaatgtcccaggcattgggcatcccggtggtgcccatctccgctgtgaaaaaccagggcgtggacgagcttgtgaaggttgccgtccagactgcccggaccaagacgctgcctacggtgtacgacttctgctcccccggaccggtccaccggtgcatccacgcggtggtccaccagatcgaggatcacgcggaggctgcgggccttcccgtccgattcgccgccaccaagctcattgagggagacgaggacatcgtgacccgcctggccctggaccagaacgagctggagctcattgagcacagcgtcaaggagatggaggacgagtgcggcatggaccgcaatgccgcactggcggatatgcgctacaccttcatcgaaaccatctgctccggcacggtggtgaagtgccgggagtcccgggagcgggcccgcagcgaggccatcgatcgggtggtgaccaacaaatacctggccctgccactgttcttcgccatcatgctgggcatcttcttcctgacctttgaagtcatcggcgccttcctgtcggatctgctggccgcggggatcgatgccctcaccgcggcggtggacagcggcctcgccgcctatggattgaaccccgtggtccacagtctggtgatcgacggcgtgttcgcgggagtgggcagtgtactgagctttctgcccatcatcgtggtgctgttcttcttcctctccattttggaggacacgggctacatggcccgtgtggccttcgtcatggaccagctgctgcggaagatcggtctctccggccggagcattgtccccatgctggtgggcttcggttgctcagtgcccgccatcatgtccacccggacactggcctcggagcgggaccggcggatgaccatcctgctgacgcccttcatgagctgctctgccaagatccctatctacggcgtgttttccgccgcctttttcccgaatcatgccgccctggtgatgatcgggctgtacatcctgggtatcctggtgggcatcgtggcggccaaggtgctgggcaccacagtctacaagggcaaccccgtgcccttcgtcatggagctgcccaactaccgcttcccctccgccaaaagcgtgtggcagctgtgctgggacaaggccaaggattttctgacccgagccttcaccatcatcttcgtggccaccatcatcgtctggttcctccagacctttgacacccggctgaacctggtggatgacagcgccgacagtctgctggccaccgtgggtgcctggatcgccccgctcttcgctcctctgggctttgccgattggcgggtctccactgccctcatcaccgggttcatcgcaaaggagtccgtcatctccacccttggaatccttaccgggtccggcgcggatgtcagcaccgccgccctggggacgctgttcacccctgtcactgccgccgggttccttgccttcaccctgctgtacaccccctgcgtggccgctatctccgcagtgaagcgggagctgggctccggctggaaggccgccggtgtggcgttgagccagtgcgtgattgcctggatggtggccttcctggtctaccacatcgcggcgctgctgctgggatagaggaggctgccatgctggaagttttgatcctggcggccctgggcgtctggctggcgcttgccctccgttcctgcctccgccgcagaggaaagggctgcggcggctgtgatggctgctgtgaccgctgcggcggtgcctgccgcagcgcccgccgctgacataccccatattgtcggtaaaacggccccggcggaatgttccgccggggccttgctgaaaagaacccccgccggctgtctccggtgggggttcgcctcatgtgtccagcagcaccgtgccgtccggcaggataaaccggtctgtggagggggtgctcagatctgccgtcagggatgccatgcggtagatggtctccccctccaacagccgttccgacgctaccagtaagcctgtctccacgctgacccagtaccgttgggtgtaaccctccggatcctggaccgtctccacgtaaatgcagttcacatcggagacgctgcggtaatccgcggcggcgatatcctccaccggcaggtccaggatggtctcataggtggggatggcctgctcgtcatccggggtgatgtcccccgcaggggcgctgtaaacgctgctctcgctgccataccagatataagtgatctccccgtcggtgatggtgtggcgaacctgtccgtccgacagggagcggtctgtccgtgtccagcggccgctgaccgtgacggtggtctcaaaggaaccgctgccgccgtcccacagctgctccacccggatcacccggctgtactgccgcgggcgggtcagcgtctcaatggcggtctgcaccgtctccggcgtcaccgcgatcactgtcagggcgtcaccgccggaggcattggtatcctctgcctgtccgggggagctcccctcctccggcagcgtgatatgggaggagcggcgcagactgttgctgaacatcaggatcagaaccatcaccaccaggacaataaagcccgcggtgatccggttcagcttccgtttctccatctccgccctcctctctcagggtgccgtccgcggcaggtcagacgccgaattctgccggccgatcccgccgcaggccgaacttccactcgatggcatcggcaatccggcggcaggcatggccgtcaccgtaaggattcaccgcgtgggccatggcgtcgtaggcgctcttgtcccggatcagccgctccgccatggtgacgatgtcatcctgtaccacgccgcagagcttcacggtcccggcctctaccgcctccggccgctccgtctcccggcgcatcaccagcaccggcttgcccagggcaggggcctcctcctggagaccaccggagtctgtcagcaccagataagaccgggccataaggttatgcatctcgtccgccggcagcgggtcgatgagatggacccggggcgcgccccgaagataggtgtccactgcttcccgcaccaccgggctcaggtgcaccgggtacaccagctccacgtcccggttctcctcggcgatctgccgcagggccagcatgatgttcttcatcggctcgccataattctcccgccggtggcaggtaacaagaacgatcttcttctccccatagggcagctgattcagctcctctgtggaaaagcggtagtccggccggactgtggtcttcaaagcgtcgatgaccgtgttgccggtgacgaacagccccttggtaataccctcccgctccaggttggcccgattgttggcggtgggacagaaatacaggtccgcaatggcggacaccagcttccggttcatctcctctggaaagggagaatacttgtcataggttcgcaatcctgcctccacgtgcccaacggacacctgatggtaaaaggctgacagggcaccggcaaaggtggtggaggtgtccccgtgaaccaggatcatatccggcttcagggcgtcgatggcctcgtccatgccggtgaggcacttgctggtgatggtggacagcgtctgccggggggtcatgatgtccagatcccagtccggcttcacctgaaagacctccagcacgctgtccagcatctgccggtgctgggcggtgacgcagcagaggctctcgatcccctcccgattcgccagctcctgcaccagggggcacatcttgatggcctccggccgggtgccgaagacgctcatgatccgcagcttttccatttacttctcctccgtctttccatcatcctccggcttgtccgctggatgatggccgtggtggccgtgctccttcagctcctccaactcttcgtgcagctcctccttgacctccttggggaacaccacccgggcggccaccactgccacgatgcacagcaccaggaacagcagcatggcccggccctccccgctggtagtcagcaccacggcgctcaagcccaggatggcagagatcacgtacagagtagccaccgcctgcttctggttcaggcccatgtcgatgagccggtggtggatgtggctccggtcggcgtgcatggggctctggccgtgggcgatgcggcggatgaaggcaaaggcggtgtcaaagatgggcagtcccagaatcaggaatggcaccgcaaaggagatgatggcatagaacttgaacaggccctggatggacatggtggccaaaatgtagcccaggaaggtggcgccggtgtcgcccataaacatcttggcggggttcatgttgtagggcatgaagcccacgcaggcccccaccagggccgccatcaccacagccacctgaaactgcccgccaatgagggcgatcaccagcactgtggtggcggagatggcggagacgccgttggccaggccgtccaggccgtcgatcaggttcaccgcgttggtgatggcaacaatccaaagcaccgtcaggggcacggagagatttcccagcacccaatagggattgtccgaaaagacgttggggttggaaaacgcctggatcaccacgccgtgggtggcggggatcagggcggccacgatctgcaccacaaatttcagcagcgccggcagggccatgatgtcgtccaccacgcccagcaccacgatgataacggctcccagcaggatgctgcgcatctcggccgtgatctccacaaacagcaggatgctgaccatgaagccgataaagatggccagtccccccagccgggggatgggagtcttgtgcatccggcgggcgtccttgggtacgtcgatggcccccaccttgtaagcaaaagtcttgacgatgggcgtcatcagaaagctgacgaccagcgccaccagcagcgccagcagcgtataggcgatcagccggttttcgatcaacatgatgtctcctccatcaccggggcaggaagcccacctttttatagaccttgttcagggtccggttggctacataggccgccttctccgcaccggcgcggtagacgctctccagatagctcttgtccgccagcaggcgctccgtctcctcccggatgggccgcagcagctccaccacggactcacccaccgcctgcttgaagtcgccgtagccatggccggcgaactcctgctcgatggtctcaaagctcttgccggtggccacggcgtagatctgcatcaggttggacacaccgggcttgtcggccgggtcaaagcggacgcaggcctcggagtccgtcacggccttcttgaacttgcgcaggatgtcctccggcttttccagcatgtagacgcagccgttggggtccttgtcggatttgctcatcttcttttccgggctggtgaggctcatgaccctggcgcccacctgtgggatatagggatccggcagcttaaaggtatcaccgtagatcccgttgaaccgggtggcgatgtcccggcagatctccacgtgctgcttctggtcgccgcccaccggcaccaggtctgcctggtacagcaggatgtcggcggccatcagggccggataggtgaagaggccggcgttgatgttgtcggcgttcttggcggacttgtccttgaactgggtcatgcggctgagctcgccgaacatggtgtagcagtccagtacccagcccagctgggcgtgggcaggcacgtgggactggacgaacagcacgtttttctccgggtccaggccgctggcaatgtaggccgccacctgggtcagggtatgccgccgcagctcagcgggcacctgccgcactgtgatggtgtgcatgtctgccagcatgtagtagcagtcatattcgtcagccagagccgcccagttcttgatggcccccagataggaacccagggtcaggtcgccggagggctggatgccgctcaggattcgttttttctgtacttcgttttccattttgtatccacctcaaatactcaagctgccaggcatctctgccggatggcggccggttttccttatatcgagataactattatattataccatacaacattattctgtgcaatctttgattgcgctcccagacgttgcgtgttacaatacccccataaccgcagctgctctgcaaagaggagggatgggacgtgctccccaaaatcggaatcctgtgcgccggagatgacgagctcgcgccgttcctgcctcttctggacaggcgctccgtccgccggcaggccatgctcacgatccacgagggatggatctccagcgttcctgccgccgctctgtacagtggtgtctgcaaggtcaatgcggccatcgctgcccaggtcctcattgacagctgccgggtggaagccatcatcaatgcgggcacagcaggaggcatcgacccatccatctccatctttgataccgtcatcagcacagagaccgcctatcacgatgtagctgaggatattctcacggagttccatccctggatggactccatctggttcccggggaccccttcctgctctccttggccacccaggcggcccaggactccggccgccccgtccgcttcgggcggatggtgaccggagaagcctttctctctggccctgggacagaggccgtgcggtccgcatttcaccccctttgcgcggatatggaatccgcggccgttgcccatgtctgccatgcaaacggcatcccattcctctccattcgcaccatcaccgattcggccgaccgatccgccgccgcctgctttgaggaaaactgccgccgggcttctgaaatcgcagcccaggtgacccacgccctgttgaaacgcctggccgtcagcgagtcctacccgattgaaaaaggagaactgccatgacgcatttctgtacctgccaaaacaccgcctgccgctgccatccctccaaccatagccaggggtgcgatctgtgcattcagaaagagctgcgcaaaggcgagatccccagctgctttttcaatctggtgatccgacccggggagacagtggaggattgtaccatggcggccttcgcccgacgggtgctggagcgggaggcggagatggccgcctctgataaacagtagctgaccccggacagaaaaacggagggagcgcatcgcgctccctccgccttcttttcaaaaacagggtccggggcaggctcaggccttgtggtcgcagcccagcacgtccacgatcttgtgggacaccagctccttgatggcggcgcgggcgggcttcaggtactcgcggggatcgaacttgtcggggtgctccgccatgaacttgcggatggtgccggtcatggccagacgcaggtcggagtcaatgttgatcttgcacacggcgctacgggcagccttgcgcagctgttcctcgggaatgcccacggcatcaggcatcttaccgccgaattcgttgaccatacggacgaactcctggggcacggaagaggagccatgaagcacaatggggaatccgggcaggcgcttcacgacctcgtccaggatatcaaagcgcaggggaggcggaaccagctcgcccttctcgttgcgggtgcactgggcggcagtgaacttgtaagcgccgtggctggtgccgatggcgatagccagggagtcgcagccggtcttctccacgaactcctggacctcctcgggatgagtgtagtgggactcctcggcagagaccttcacgtcatcctcgatgccggccagagcgcccagctcggcctccacaaccacgccgtggtcgtgggcgtactcaaccaccttcttggtgatttcaatgttctcagcaaagggcttgctggaggcgtcgatcatgacggaggtaaagccgccgtcgatgcagctcttgcaggtctcaaagtcagggccgtggtccagatgcagggcgatggggatgttggggcactcgatgacggccgcctccaccagcttcaccagataggtgtggttggcgtaggcccgggcgcccttggacacctggagaatcaggggagcctccagatcccgggcggcctcggtgatgccctggacgatctccatattgttgacgttgaacgcgccgatggcatagccgccgtcgtaggcttttttgaacatttcggtcgtggtaaccagtgccataagatcaactcctgttcatttatttgtcccgctctcccacatcggccgacaggtccgatcccggttgtcaaaaaacgccgattcaaaagaacgaaaacgattttcccttatgataatatcacaagatttttaaaatgcaagtatttacaattctttttttgaatgatatgatgaaagaaagcatcccgaaaccaaatctgaggaggatttttccatgagtgaactgaaaggcgcctgcattttcggccagtccggcggccctacttccgtcatcaacgctagtgcctacggcgtcatcgccacggcattgaagaaccccagcatcacccgcgtcctgggcgcggagcacggcatcaagggcgttttgaacgaccggctgtttgatatgggccaggaggacccggcagagctggagctgctgaaatacaccccctcctctgccctgggctcctgccggtacaagatggcggacccggatgtggatgacaccgactacaagcggattctggagatcttcaagaagtatgacgtccgctacttcttctacaacggcggcaacgactctatggacacctgcaacaagatcagcaagtacatgcagaaggtcggctatgagtgccgcgtgatgggcgtgcccaagaccatcgacaacgacctgtttggaaccgaccactgccccggcttcgcctccgccgccaagtatattgccaccagctgcatggaggtctatcaggatgcccgagtgtatgacaccggcatggtctgcatcatcgagatcatgggccgccacgccggctggctggctggcgccgccgccctggccaccgcctacggcgccggccccgatctggtgtacctgcccgaggtggacttcgacatggatcagttcctggccgacgtggagcgcatctacaaggagaagggcaactgcatggtggccgtctccgagggcatccactacgccgacggctccttcgtctccgaggccaagacctctgccaccgacggcttcggccacgcccagctgggcggcctggcctccctgctggcccaggtagtcaaggagaagaccggcgccaaggtccggggcatcgagctctccctcctccagcggtgcggtgcccacctggcgtccgagaccgatatcgaggaggccgtcatgagcggcatggccgctgtggagaacgccgtcaatggtatcaccgacaagatggtgggcttcgagcgcagctatgaggacggccagtacgtctgcaagaccaagctgctgcccctgaccgatgtggccaacaccgagaagaaggtgcccatcgagtggatcaacgctgcccacaacggcgtggagaagcccttcatcgactatgtgctgcccctgatccagggcgagcccaagctgcccaaggaggactccctgccccgcttcgccaagctgaaaaaggtgctggtgaagtaagcggcagcgaaaccccagaacaggaaagagatcacccgctttgggtgatctctttttcttcagcaccgtgtctctcggtagacagagtacaagaaatgaagcatttctccgctgtaatatcgggtgagaaacgtatcttccttgcgcatgccgatgctctccgccaccctgattgacgcaaggttatccgatttgatgatggacgatacccggtcccgcttcagttgttcaaacgcatatcgtttacagccttcagctgcctctcttgcatacccgcagtgccagaactccttcttgagcagatatccgatttcaagcacgtctttatttcgatatggctgcatagtaaggcctgcctgcccaaccatgacaccactggttttcgatatgaccgcccacaggccaaatccatagtcccgatatcgtccgatctgccggtcaagccattgttggacatccgagttggaaaaatcatgttcataggcatacatcaccttcggattttgcagcatctccgccaaatcaagaaaatcatcctgattcatttctctgaaagccagacgttctgtctcgaaaaccacaggactgcttgcccccaatgtcattgttctcacttgttcttctgatagatcgcccacagcccgtccatcagcaggtacttgtcgtagacgatcttgttccggcagtatttcacgatcaccggggcattgccgccggtggccaccacgctgagtgtccgtcctgagaactgctcccggatgcggtcgatgacgccgtccagcatcccggcggtgccgtagacgatgccggagcgcatacagtcctccgtcgtcttgccaatcaacaccttggggtgctggagggagatggcgggcagctgggccgcccggcggctcagggcctccagggacacgttgacccccggcagcagcatcccgccctcgtaattccggccctcggagatgacgccgatggtggtggcggtgcccatgtcgatggtgacgataggaggctcgaatttctccagcgccgccaccgcgtcggccacgatgtccgcccctacctgggactggaccgccagccggatgttcagccccgtccgcacaccgggccccaccaccatgggcggcttgcccagcagccgggccagagccttctccatcatgaagttcagggggggaccacgctgcacaggatcgcccccgtcacatcctcaaaccggaagtgatacagggcgaacaggttcatcaggtcgatgctgatctggtctgcggtcttgcggctgtccgtgtccagggatgccagaaaccgcagctgcttgtccctgtcaaacagccccacagaggtgttggagtttcctacatcaatggccagcagcataagcctctctccttttttcttctgatcttgatcgtgttctatggtatcacgccttgccgccggatgcaaggccgggacagagggaaaatttttcgatgaaacgtccgaaaacgggaagaaatctgccgccggatctgctatacttttgttgaacacacgcgaaaggaggaggcgccatggattttccctatggtgaaacggagattgcctatctgcgtgccagagacctgaaactgggcgcggccatggaccggatcagccccatccatcgggaggtggacccggacctcttctcctccgtaatccatcacatcatcggccagcaggtatccatggctgcccagcggacagtgtggcagcggctccaggcagcggccgggacgcttgtgccggagacggtcgcggccatgccggccgaggcgctccaggccctgggcatgacccgccgccgggcgctgtacatcctggaatttgcccggaaagcggcctccggggattttgatctagacgccctggcggaaatggaggaccgtgaggtgctggcccgcctcacctccctgcggggtgtggggccttggacagcggagatgctgctgatcttcggcctccggcggccggatgtggtcagctggggcgacttggccatcctccgggggatgcggatgctgtaccgaaagcggtccatcgaccagaggaccttccagcgcctgcagaagcggtacagcccctacggcaccactgccagcctgtacctctgggccatcgcctgcggcgccctgccggagctgacggaccctggcgccggacggaaaccggacaaaaaacgggggcggcacacatgacagaccggcagcgctggcaggcggtcctggacaacgaccgccggtatgatggcacatttttctacggcgtagcctccacaggcatcttctgccgtccctcctgcccctcccgaccgccgcggcgggaccgggtgcggttcttccccacggcggacgctgcactggcggcggggttccgcccctgcaagcgctgccgcccggacctgaccgatttttccccgggccaagacgttgctgcggaggccatggcgctgctgcatcgccacttccgggatcaggcggacttgtcagccgcgctgaacggcctgggactctcccgccggaggttggccgatctgttccatgcagcctacggcaccaccctccacggctgcctgggaacgcttcgggtaaccgaagcctgccgcctgctgcgggagacggaccagcccgttgcccaaatagccggggaggccggatttgacagtctctccgccttttaccgggccttccggtccggcacaggacagtccccgctggcgtaccgccggagcgcccattccgcgccggacaaatcaagcggtccctgttgaacgacttacattcgtttgcaatcgctccatcactctgatcctgatttgaggtgtaattgtatgtggatgatctttcataagccctccccggtgggaatgctgaccctctcctcggacggcacagccctcacagggctgtggctggatgggcagaaatactttggtgctggactcccaaatgctgtaaaggaaaatgacctgccggtatttgagcaggtctccgcctggctggacgcctattttgccaaggctccccttccggctctgccgcctctggccccccagggcagccccttccgccaggcggtgtggcgcctgctgctggagatcccctacggcacggtcaccacatacggcgccctggcccggacgctccggggccaggggatttctgccgcggcccaggcagtgggcggcgccgtgggccacaaccccatctccattctgatcccctgtcaccgggttgtgggcagcgacggaagtctgacaggctacgccggaggcgtggccaacaagcagttcttgctggagctggagggcgtggacatgaccgggctgtatgtccccactcgtggcacggcgctgtgagacgcaggtggtctccatggcgcacacacgaaaaaagatgttttacgcgccgaaggcgttcaacggctatgggccgccggagcctccgattccggcagctcaggatcggcccgggcgctatccctgtccctgctgtgggcagatcaccctcccggtcccgccggaggaggcggtggcttacatctgcccggtatgctggtgggagaacgacgtgttcatttcctccgacaacgagcccagcgacgaaaatcatgggctgaccctgtcccaggggcgggaaaatgtccggcggttcggcacctgcgatccccggatgaagcggtgagggcatcggaggaaatttcttcttcagggatgcctttgggacatctgaacaggaatcccccaatccttgcgctgttcggcgtcttttggttccctttgtggtggtcggtctcacgtataccgggcgagtcggccttttcccagctccctccgggacaggctggaatagtaagaaagggcgccggattcctccggcgccctttctatgatgtctgcgtcacagaatgatgcagatgagtcccccgctgccctcattaatgatgcgggtcagggtctcctggagcttccgccgggcgtcctccggcatccgcttgagctttgcctgcagatcctcgttcaccagctcgtggaagctgcgtccgaagatgttggactgccagatcttgctggtatccccttcaaactcctgcagcaggtagttcaccatgtcctcggactgcttctcgttgcccacgatggggctgacggcagtctcgatgtccgcccggatcatgtggatgctgggggcgctggccttcagccgcacgccgtaccggccgccctgcttcatgatctccggctcctccagcttcagctcgtcgatgccggggaccacgatgccgtagcccgtctctcggacgtcgtggagggcgccggctaccttgtcgtactccgccttcaccgccgccagcttcgtcagcaggctcatcagatccccatcatcccccacctcaaagccggactgctccgacagggtcttgtagaacagctcccggggcaaggccagccgtgcggcggccacgccggtgcccaggtcgatggctgagattctggcctcactgatgtgctcgctctcccccagggcggcgatgacgccctccacctcccggatgtggcggagctgggcggtgttctgacggatggcgtcatacaggcccgctttgataggatggtccgccggcaaggcatccacccaggggggcaggaacaggtccagctcctgcatggggaactcgtagagcaccgccttcaggatggcggccacggcgtcctcgtccagctccaggcagttgacggccatgcagttcacctcataccgggaggagatgtccttggcgatggcttgggcccggtcgccccgggggtctgcggagttcagcaggacgatgaagggcttccccagctcctgcagctcccggatcacccgctcctccgcttccaggtagtcctcccgggggatgtcggagatggtgccgtcggtagtgatgacgatgccgatggtggagtgctcggcgatcaccttccgggtgccgatctccgccgcctcggtcatggggatctcatggtcgtaccagggggtggtgaccatccggggggtgtcgtcctccatctggccgatggcgcccttcaccatgtatcccacacagtcgatcagccgcacggaaaagctcgccccgtccggcagctggatctgggcagcctcctccgggacgaacttgggctcggcggtcatgatggtccggccagagccgctctgaggcagctcatcccgggcccgctccttgcggtagacgttgtcgatgttggggatcacctgggtctccatgaaccgcttgatgaaggtggacttcccggtgcgcacggggcccaccacgccgatgtagatatccccagcggtgcgggtggcgatattctgatagatactggtattcatagcatcccgtcctttttccgctccatagtcttgttccactctatgtccggctgctgcgaagtatgacagcccgtcttgttttggagaagatgcacaaattcaggagccggccttctccgttcttggctgattttgcggctttacacggataatttagtgtggtaaactgctaatgtaatgaaacggacggtatctccgtccagagatttggaggattgacgatgaaaaacatgaagaagctgtgggcagcgctgctggccctggccatgaccttctctctggccgcctgcggcggaacctctgacgaggacgccgccactgatgaccagcccacaggggaagaagtctccggtgacaccgctcccgagagcgacgtggcctatatccaggataagggcaccctggtggtgggcattacctactttgcccccatggactacaaggaagagggcagcgatgagtggatcggctttgacgccgacctggccaagctgtttgccgagagcctgggcgtctccgtggagttccaggagatcacctgggactacaaggtggaagagctggactcccgggccatcgactgcgtgtggaatggtatgactctcaccgacgacgttctggctgctatgggtacgtccaacccatactgcaccaactaccagactctggtctatcctgccgaccgggccgctgagttcgagggcctgacctctctggagggcctgaacatcgctgtggagtccggctccgccggtgaggatgccgccgtggccttgggtgccaccaccgtgccggtccaggcccagtccaacgccctgatggaggttgccgccggcacgtccgacgccgccgtcatcgacgtgctgatggccgctgagatgaccggcgagggcaccagctacgccgatctgatctacagcctgaacctgaatgaggcccaggacctgccctccgaggaatatggcgtgggcttccggcaggggtccgacttggtggacgccttcaacaccttcctggcggagaagacggctgacggcaccgtgctggaggtggctaccacctacggcctgcaggacgccgtgatcctggagtgagcttcttcccctgcggatcttccaaaagcagagtgcgcagtgcgcgctctgcttttcggcggctttccccctctaccacactgaccttgagaggacgataccatgattgaattttttacctccagcacattccggaccgtgctgtcggccctgaacagcggatttctcaagacccttcagctgtttttcatcaccctgatcggggcactgcccctgggcttggttatcagcttcggttccatgagccgctttcctcccctgcggtggctgacccgcctggtggtctgggtcatccggggcacgcctctggtgctgcaaatcattgcactgttctatgtgcccggcatccagaagtggttcaactggcccagcggtgagtccgggcggatgatggccgtgtgtgtggccttcatcattaattacgcctgctacttctccgagatctaccggggcggcatccagggagtgccgaagggccagcaggaggcaggccaggtcttgggcatgaccaaagcccagatcttccgccacatcaccctgctgcagatgatcaagcgaatcgtcccccccatctccaacgagatcatcacgttggtgaaggacacctccctggcccgggtcatcgcattgcaggaggtcatctggatgggcgagtcctttatgaagggcaactccggcattgcgggcctggtgtggcccctgttcttcaccgctgtctactatctgatcttcagcggcatcgtcacggtgctgctgggcaagcttgaaaaaaagctggacttctttcagtaaggagggaaccgatttatggcaattctggaagtacatcacattgaaaagcatttcggcgccacccgggtgctggaggacatcagctttgatctggagcagggccaggccctggccatcatcggctcctccggctccggcaaaaccaccctgctgcggtgcctgaatttcctggagaagccggagcagggtaccatctctgtggcgggtaatctgatttttgacgccgctgatcccgccacccagcgggagagcgaggtgcggaagaagcggctccacttcgggctggtgtttcagtccttcaatctgttcccccaatacacggcgctgaagaacgtcaccctggcccgggagctgctggcccaggagcagccggacttcaagcagaacaaaaagcaaatcctggaggagatccaagcggacggccgggagctgctggcgaagatgggcctcagtgagcgggcaaatcactaccccagccagctctccggcggacagcagcagcgggtggccatcgcccgggccctggccttgcacccggacatcctctgctttgacgagcccacctccgccctggacccggaactcaccggcgaggtgcttcgggtcattcgggagctggcggaacagcggaccaccatgattatcgtcacccatgagatggcctttgcccgggatgtggcagaccaggtgatcttcatggacggcggcgtcatcgtggagcagggtgacgcccaccaagtcattgagcaccccagggaggaacggacccgtcagttcctcgcccgatattccgagggataaaacggaacagaaaaagagcggagctgatgctccgctcttttgttatcttgtgccgtcttgttaagacggggcaacgggaaactccgtcaatcaggcaggtttggatctccggcggcccagcaatcgcccgatgagaaggcccaaggcagagatggccgccccgatgaaaaacaggtcccactgaggcaggttgatcttgtcaaaggccaacatattggcgagccggaaggtgagaaagtccgccagcatatacaaaagtcccagggccagaggcagcagccacatgcgcccatccctgcggaccagttccccaatccgcagggagatcacaaaggcggcgatgggcaggagcagccagtggaataaaagggcgtaccccatggcgtccgtggggtccatcaacaagaacaccaccagggcaaaaacccagagtcccaggtaaaccgctaccagccgcctcggggaccgccagctcctccccttggctccccgaacacgcaccgcaaagtccggcataggcacctccacttcccagagggcagacgaaacagaccgaatacccgttttttccagtctaccatgggctgccggacccgtcaagggtgactcaggtccgcttccgggggatcagcagcagctggtcccgggagatatctccttccgtctccagttgattggctgccaggatcacgccgatggtggtgttgtaccgtttcgccagatcccaggcggtctcctgcttccccaggcaacgcagcaccagggacggcgcgccggtggtctccttaggcgcgtctgtattgatctttcctgcggacacgcacacccgtttcacacgctgggccgcctccgcccggaagtccaccgggaaccggacctcgatgccccggtccgtcaggctgccctggacctcttccgggcagacggcccgggcagcgacccggcagtcctccggcagctccagttggcagctgacgtcgatgctccgctccgccaccagaggcacgcccccctcgtccagatacagtgcccggacagacgccccggtccgcaggaccacgcccgccccctcccggctgacggaaacagctccgcaggtgacggagagggccaggatggaatccgccaccacaccgatctccagcacctcccgcaccgtctgacggcgggtgaactgttctcgaaagctggtgagttccagaggcgcggcgtcataagtcagatcataggcagtggagtagaggtcactgaggagcgtcagttcctgggtctggcgcagcagagctgtggcgtggaggtacagcgtcaccgcgatctcccggccctcggcgtcggcgccgtcgacctgcagatccgcgccggtgaactggaggcgcaccgatggctccgcgccctccggggcgccttccacctccaggatctgagagaacggcagctctccggacgcggcgcagcagcggccgtccgccgtccggtacaggaggctgacggtgaagatacccttgaacagcagcttgctgcccacgatcttcgtctccgtcacagtgctgttcacccggctggtgaggatctccgccgctccctctctgcccggggacaggtccatctgttcggagaaggtgaagtccttctccgcaatgtgggtcaggacgatggcgtgctgctgctcctgctttttttcgatgcacagttccggccccgcctctgcatccgtgcagaagcataagggcctgcgctgatagcctgtcagccgcgtcaccagcttgcagtgggtgaagaccttgcgggggttcagcatccgggtctccagaagctccggctccgtgtccgccagcagcgccgcgcagtccggcagactgcgtccgtcggtctccaccgtgaagggcatggcaaattccagggtccggatgcccccctccccctccggcgtgtacagcaccgtcacccggacggtgccggagatctctgccctgccgtcccgcatctcccggctgtgcaggaacaccttgcccgtggtctcgatgatccgcgcaatgtccggacagtagtccggcacgatggtctccgctgtctcctcctgagtcaatgtcagctctcccgccgcctcataggcgtcgaagcaggcctttttcaattccagttccatggttcgcccttcctttccggccgttggtcctccgatggacggcgcagccgtttcccgccgcctggaaaacggtacggggcgggaggggccgccagcggccgctctcccgcccctgtgcgccgccatgttgtccacggagtctcgctctgctgacactgtatgcccggccgggactgcttattccgaaatcttgaacagcttccgcagaatgccgctgagggctttgggggacttccacactacaattcgcatgatatttgctcctttctaacgcctgcagcaggcgcagccgcacgcaatcagcaggaccgccaccaaaaacatcagcgcccctaccggaaagatcgccgcaatcaggatcccggcccccagcgccaccgcacagacgcccagtatccagcatccgccgcctctccgaaacatacgccccacgcccctttctcactcccattatatacgccgctgcctgtcctggtacaaaaggcagggcacacaaaaagaggcgggcagatgcccgcctcttccgcgcgattcacttcttccgctcctgccagtcctggaggggcttcagctcctcatacaggcgcacatagctggcgtggcggctccgttggatcttgccagcgcgcaccgcctccagcacggcgcagcccttctccttggtgtggctgcaccccacgaagcggcactggtccagataaggccggaactccacaaaggtctccggcaggcggtgcttcagctccagattcagctcatcggtctcaaaggaggagaagcccggggagtccacaacgtccgccccgcagctcaggtggaacagctccacgtgccgggtggtgtggcgtccccggcccagcgcctggctcacatcccccacctggagctgaaacgccggatccagggcattcaggatgctggactttcccacaccggaattccctgtaaaggcagacagcttcccggcgatcaggggcttcaattcctcgatcccctccccggtctccgcgctgacccgcagagttggaaatccggcggctgcgtaaatggcgtacagcgcatcggcacagtccagatcgcatttgttcagcagcaccatcacgctgcatcctttcagtgctgcgatggccgccacccggtcaatgaggaacgggtctgttttggggatggcaccggaggcgatgaccaccagctggtcgatgttggccaccgccggccgggaaaatgcgttcttccggggcaggatggcctccacaaagccctcgccgttccccagctcccggacctccacccggtcccccaccagaggggagatgccctccttccgaaacttgccccgggcccggcaggtgagcacctcgctgccggtgtccacatagtagaagccgctgagggcctttcggatccgtccctcactcaccgaaggtcacctcacgggtattgttcacatccatcacgccgtccacgtacacctccacggagaccgttccggtgccgtacagctcatagacatagttgccatctcggcaggggaccgactcgttgaccttgatcactccgtccaccacgatctgaacttctgctgtctcccggtctgtgggcagggcgataatcagcggttccatttgcaggtcttcattgccgccgctctccgggccggtgctgacccacagctccactgtgctgccggcaggcacctgcgtggtagccgtcgggttctgacggataaccagacccgcttccacagtgtcgttggcctcctcatggacctcgacctccaggcccagcacgttcttcagctggtcctccgcccaggcacgttccctattcgtgaaatcgatcagcggcacggtctggggtccccggctgaggacaaaggtgatggtgtcccccttgtggagttcttcattcgccgccggggtggtggacttgatgacgtcaacggccagctcgtcatcgtactccttctgggtctcctcatagggctggacgttcagttcatattccgccaccagatcctgcaggatggtcatggcctggtcataggtcatgggcttggtggtcaggtccggcatggtgcccacgtcctcaccggcgctgacccagacgttgatggtgatgggcagctcacccttcttctccgtgtccggctccgggtcctggcggacgatttcacccacggcggcgtcgctggcctcggtgcccgccaccaccacctggaaggtgccgtccgccacactggcctgctcgttggcctgctcctccgtcatgcccaccagcttgggtacggtgtaggtgtccggcgccgccgggacaaaggaggcgaagatggcccggaacaggaagaacaggaccaccacgaccactacggcaccgccgccgatcaacgcgatcttcttgccgccgctgaggcgggagggctgttcgtcctcgtagcgatcctcctcccaccggcgtccccgctcataggagggctcccggccctgccggtggagctggggcggcacagcggagcggagcttctgagtgggctcgtcggtctcctccggccgcaggtcggacagctcgaagtccagattcacgccggggttcttccgaaaggcctccagatctgcgatcatcgcgtctgcggaggggtagcgcttctccagatccggtgccatggccttcatgcagatcagctccagctgctcggggatgtccggattcacctcccggggagccaggggcacggagctcaggtgctggatggccacggatacggcgctgtccccctcaaagggcaggcggccggtgagcatctcatacagcaccacgccggcggaatagatgtcgctgcgggcgtcggtgcggtccccgcgggcctgctccggagagatgtagtggacggagcccagagcctcctgggtcagggtctgggcggcgttctccaggcaggcgatgccgaagtcggctaccttcacgctgccgtcccgcagcaccatcacgttctggggcttgatatcccggtggacgatgccccggctgtgggcgtggctgaggccccgcatgatctgtgtaatgaagtgcagcgactcccgccagttcagctgcccccgcttctccatgtactgcttcagcgtgatgccgtcgatcagctccatgacgatatactcgatatcgccgcccttggacacgtcgtacaccgatacgatgttggggtgagacagttgggcgactgcctgggattctgcgttgaaccggcggcggaagtcctcgtcctgggccaggtcgctcttgagaatcttgacggccaccaggcggttcagccggtggcacttggccttgtacacaatcgccatgcccccggtgccgatacgctccagaatctcatagcggttgtccagcatttttccaatatacgggtccttgtgttccatgtgtctccccctttactgtttttgcatcaggacggccgtgacattgtccggcgcgccctggcgcttggcgatggcgagcagccggtccaggcaggtgtccggcccgtcccgtggatgacctcgaagagcatctcctgatcggtgacggtgttcaccagtccgtcggaacacagtagcaggtactccccggcgttcatcgggcatatgtacccgtcacagtcggcggagatgtccggtcccagggcccgggtgatgagattgcggctggggtggcggcgggcctcctcagcggtgatgtctccccggtctaccatgctttccaccagggagtggtccttggtgatgcgggtgatgccgtcctccgtgatgtgataagcccggctgtcccccacgttggtgaccaccacgccgccgtcataggagatggcggacaccagggtagtgcccatgttccggcattcctcccggcgctctgcctccgcctgaatggcctgattggccagggctgccgcctgggcggatgcctccagcagctgctgaggggtctgatccgccgtcaggagcttctccagctcctccagatagacggagacggcgatctggctggccacacggcccccggcggggccgcccatgccgtcgcacaccacgcccaccgtgcggccggaggccgtgtgctgcgccgtgacgtaggcgtcctggttctccttccggacaaggccgatgtcggtcatgccccagacgttcatttggttcattgggaacactcccctttctgcgcttcttccatggccttccggcggagctgtccgcaggaggcgtcgatatctccacccaggctccgccgcacggtggcggtgatgccgtgggattccagccgtttttgaaaggccccgatccggcgggagggcttgtaggggctctccaccacgtcgttcaggggaatcaggttcacgtggcccggcatcccccggagcttcctggcgatcaggtccgcctgccagtcgtggtcgttgaccccgtcgatcatggcgtactcaaaggagatgcggcggccggtcttgtcgaagtagtcgtggcaggcccggaacagctcctccacgtcataggcccggttgatgggcatgatcttggatcgggtctcgctgtccggcgcatggagggacacagagagagtcagctgaagttcaagctccgccagccgccggatgcccggcacgatgccgcaggtggagagggagatatgccgcatcccgatgttcatcccgtcggggtggttcaccagctccaggaatttcagcaccgtgtccaggttgtccagcggctcgccgatacccatcagcacgatgttggagacgggcaggccggagtctttttgggtgaacagcacctggtccagcatctccgccggggtcaggtcccggaccttgccggcgatggtggaggcacagaaggcgcaccccatccggcaccccacctgggaggagatgcacacggtgttgccgtggtggtactgcatgagcactgtctcgatgcagttgccgtcggacagctcccagaggtatttgatggtcccgtccaaccgggacacctgcttgcgggccacctgggggcggtgatgaaacaggtctccttcagcttttcccgcagggacttggagagattggtcatcccatcgaagtccgtcaccccccggtggagccaggtgaacacctgcctgccccggaaggccggctcccccagggactggaggaaggccgtcatctccggcagggtcagtgatttcaaatcggtcatggatcgttcctcaattccgcgtcatgcggcagatgtaaaagccgtcggtgccgtggcggtggggccacagagtcacctggccctcggtctcccccaccggtccggacagggagaagggcgtgcggcaaaagtccgggtgctctgccaggaagctgtcggatacaccctcgttctcctccggcaggatcgtgcaggtggagtacaccagcgtgccgccgggcctcacgtaccgggcggcgttgtccaagatcgcccgctggatcaccggcagggcgaacaggtcgtcaggctttttgtaccggacatccggcttcttccggatgatgccgaaacccgagcagggggcgtctaccagcaccacatcgaaccgcgcctcccactccggccggaatgtccggccgtcggcggcttctgcccggatgcaggcgagtcccagccggtccgctccctcccggatgcgcttcagcttgttctcgtgaaggtcgcaggccaaaatctccccctggtcctccatcgcgaaggcggcggagaaagacttgcctcccggtgcggcgcacacgtccagcacccgcattcccggccccaccccggcgatttgggataccaaccgagccgccgggtcctggaccaggaattttcccgttcggaagggctccagcgccgtcaggtccccggcgtggtccagctctaggcatccggacacccaaggatggggccggacaatcacgccggatgccaccagctccgccgtcagctcctccgcagcagctttcagcggattcacctgaatcgtcagcggcgccggagcgttgtcggccgcaaggcaggcttccgtctccggccccagaatggcctggaggcgtttcaccagccacttgggatggctgtaccggatggagaggctgtgcagtgcatcctggtccgggatcctcggcaggtgcaccttgttccgggagagctgccgcagcaccgcgttcaccagtccggctgccttggcccggccgttgtccttggcctgctccaccgcctgattgacagcggcgctgtggggaattttatccagaaacagaatttgataagccccaatccgcagaatttccagcaacggcggctgcaagtggtcggccttttgggagcagtaggcacccaggtagaagtccagcagcagccggttctgcatcacgccgtagacgatgcggctgcacagcgccgcctctggtccggacaggccgtcccggcggagctggaccctcagggccgcatccgcccaggccccggccgtgcggcagctcaccaggacgcgcagggcggtgtcccgggcattaggggccctcattggctgcctccctgatcgcggccgccgcggccgataaagatcagcacaaaccgcatcagctgcagcaggctcatcagcagcgccgccacataggtcaacgccgcggcccgcagcacctttttggcgccgggcagctcatcctcatccagcaggcctgccccgtcgatggtggcgatggcccgggcggaggcgttgaactccaccggcagcgtcaccagctggaacagcgtggtgaaggaaaacagcacgatgccgatgaagaacagagactggttgtacagcaccagccccaccagcaacaggatgaaggacaggctggaaccgatccgcgtggcggggatgatggccgtgcgcagccgcacaggcccgtagttttccgcgtactggacagcgtggcccgcctcgtgggccgccacgcccaccgccgcgatggtgggggcgtcgtagactgtctcagacaggtagatggtattgtcccgggggtcgtagtggtctgtcagatttccccggcagggccggacaggcacaccgaataccccgtgagcccgcagcaccgcttccgccgcctgggcaccggtgatgcggcgccggttgttcacggcattgtaccgccggaagctgccggacacctggaactgggcccacagggacagcagcagcactgggatcagcagcaggacgtacagattatttgcaagaaagtcgccataaccgtaatagatatgaccgtaatagggcataaaaacctcccgaattgtgaaactggcggagctcagacctccaacgggtggcccagcagataggacgccgcagccatgcgcttgccgccctccgcctggatctccgtgagatacaggctctctcccctgccgcaggccacctggatgccctgcttcccggcggagagcactgtaccgggcgccgcgccggtctgttcgccgggggcggtgcggtagaccttgaaccgctgccctgccagatcgcaggccgcgcagggccagggaatcagtccccggacctgacagtcgatctcccgggcggagcgggtccagtcgatgggggacatctcttttgtcagcatggaggcgtaggtctgacggctctcatcctggggtgtccgggcggctgtgccgtttccgatggccgccaccgcctcgctgagggcctctgcccccaggtccgccaggcgcaccgtcagggcctgggcgtcctcgtccgggccgatgggagtctccttctgcaggatcacgtcccctgcgtccagctccttcgccatatacatgatggagacgccggtagtctcctccccgttcaggatggcccagttgatgggggccgcccccgatacttgggcagcagagacgagtggacgttgatagagccgtatctgggcacctccagaatgtcctccggcaggatgcggccgtaggccgccaccaccgtcagctccggtgccagggactgcaccagctccagcgccgtgccgtcccgcatcttcaaaggctgatagacgggaatattttctgtcaaagcaaattcctttacaggcgttggcaccagcttatgtccccggtttttgggcttgtccggctgcgtgaacacgccgcagacctcatggccgtcggccaccagccgccgcaaggacgccacggcgaagtccggcgtgcccatgaacaggatccgcatgggctcactccccttcctgagcttctgcggcctcacgggcctcccgctcttcctgctccagatagtcccgaagctcctcatcagagaggaagtggtcgatgtgctccacaaacagatggccgtccagatgctcgatctcgtggcagaaggctcgggccgtcaggccctcgccctccacctcgaaccagtcgccataccggtcctgggcccggacccggaccacgtccggccgggtgacgatgccccatttgccgggcacgctgaggcagccctccagcccggtctgctcgccgctctgagccacgatctccgggttcaccagttcgatatactcctcagagtcctcgtccagcaccacgcacacccggcgcagcactcccacctggggagcagccagcccagcgccattggcatcctccagtgtttccagcatatcgtccagcaactggtgcaggtgagggttgaactccgtcacagggcggcacacctttgtcaggcactcctctccctgcaccacgatcttccgtaaagccataagtccttgacctccttcaaaacgctgctcactccatggagttgcagtccacaaatagattcatcccgcggttggcgcggtcgtttgcaaatgccttcagcagccagctcaccgcctctcgggtgggcctgtcgttctttcccaccagcaggcagcggtagcggtagcggttattcagcttcatcaccggcgcaggggcgggacccagcacctccggttctccggccgccagctccggcagggcgcagaggcggcgcagctcttcccgcactgcgacggcggcccggaggacggcgccctcctcggtaccggagacggtgaaggtgaagaggtctgcaaatggcggaaaccgccgcaatcgccgcatccggatctcccgctcataaaacccctggtaatcctgccgagccgcgcactggatcacatcgttttccggggtgtaggtctggatcaccgcccggccggcactgccgccccggcccgcccggcccaccacctgggtcagcaggctgaaggtccgctcggcggcccggtagttgtctacatacagggacagatccgcagccagaacccccaccagtgtcacctggggaaagtccagccccttggccaccatctgggtgcccaggaggatgggaatctgctcccgctcaaacttgtccagcagctgctcatgacggcccgcggcggtgtctgcgtccatccgcagcacctccgtacccgggaacagatcgtggagctcctcctccaccttctgagtgccggtgcccacgtgcttcatgatgccgccgcagacggggcaggtgtcgctggatcgctccgagtggccgcagtagtggcacatcagccgtccattggcggagtgatacgtcagcgccacgctgcagcggggacactccggcacatggccgcactccccgcacagcagatacctgttgctgccccggcggttcagcagcaggatgctctgctctccccgccgcaagttttcctccagctcagtgcggaggacctgccccaccatcccggcgttgcccgcccggatttcctgtttcaggtccgccaccagcacctccggcaatgcctgccggttatatcgccggcgcagcagcgccttgtgatagatcccatgctccgcgttccaggcggtctccaccgccggagtggcagaccccaggaccaaggtggacttgtcccgggcgcagaggtatttggccacgtcccgggtgtgataccggggcgggttttccgactgatagctgctctcctgctcctcgtccaggacgatcaggcccacgtttttcagcggggcgaagatggcggaccgggtgcccagcaccacctggacctcgccccggcggatacgcttccactggtcgtagcgctccgtcatccgcagggagctgtggagcatggccacctggtccccaaaacaggcggagaaccgccgcatcatctggggcgtcagcacgatctccggcaccaggaccatggcccgcctcccccggctcagtatttcctgaaccagacggagatagacctgggtcttgccgctgccggtgacgccctggagcagcaccgcctccggcttcccggtcttcgtcagggtccggatacactgaaaggccgcctcctgttcctcattgaggacgataggaccgctgggttccaccgccgtcaggtccggcagccgcagctcctcttccgctgaaaaagccacgatccccgccttctccatcccccggagggcggccatggagacgcctgtgaagtagcatacctccgccgcgctcatccgcccctctgccgccaggagacgcaccgcctcccgccgctgggggaggatcgcttttccgtcagagatgcggcctcctcggcgctgacggccagttccaccatccgacgggacttgtcgccgatcctccggcgggccgcagtctcgcagaccgtgaccccggccttctgcagtgcccgcagcacagtgccagcctccttgccgcaggcctcctccagcactgacagctctgcggagcctccggcggcaaacaaggcgtccagcaccggggcggcccgtcggatgccggtggccgcgccgtcggccgcgcagcggtccatgccctctgccacatgccagacctcccggatctggtaccagagtccggcgggcaggatggccttcaccgcttcaaacagcgtgcagaagtaccgctgccgcagccacaatgccagggcgatgccatcgccgtccagtaccggccctcggtccaggaccgacagcaggggtttgagcccctgcatcttttcacctggcgtccgggccagaataatgccctcactggtgcggttgccccggccgaagggcacggtgacccggacgccgggtaccgccgtttccagcagctccgggggaaccaagtagtcatagggcttgtcaatggaatagggcgcggcgctcaccgcgattttcacgatctcagcggtttccatgcctcgcccctcctgttgttactgtgcctcttcctccgccggctgtagatcctccggttcctcaatggtcaggtccatgtttctggcgtccagcttgccgtccgccacttcctggatggccagggtgacgggcttctccgtcagatgctcgccagtctcctccgcctcgtcggcgatctgccgggcccggcgggccaccacgtccaccagcatatagcggttggggatatagccggtcagcttgttcattgcgggatacagcatcataatggatcaacttcctatctgccttgcaggcgtaaatttatttatggacaaagcgggcgtctcagcgtccgctgatgatctccatgcgctcctggggcttgcagtgctccgccgtgataatggcgttcagctcccccaccgcattctccacggtgtcgttgatgacaaagtaatcataggtgtgggccgtctgaaactccactttggcccgcagcagccgcttctggatcttctcggggctgtcggtgccccgctctgtcaggcggcgctccagctccgcccagctgggaggggcgatgaagatgcgcaccgtgtccggccgcttgctgcacacctggatggcgccctggatctcaatatccaggatcacgtccttcccggcctccatggcatcgtccacaaacttcttgggtgtgccgtagaagttccccacatactccgcgtactccaggaattggtccatggcgatccacttccggaaggactccacgtccatgaagtggtagtggatgccgtccagctctccgggacgcgggtcccgcgtggtggccgacacagaaaaatacagattcttccgggactccagcagggccttgagcaccgtgctcttccccacgccggaggggccggagaccacaaaggtcctcccctttctcatatacacacgctcctattcttcgttctctctctcttccttcggtgcgaaccgctccggcggcagggccgacagtaccacgtggtcactgtccatgataaaaatggacgcggtcttgcggccgtaggtggcgtcgatcagcattccccgctcccgggactcctgcaccatgcgcttgatgggggccgagtccggccccaccacagccaccagccggtcagcggagaccagattgccgaatccgatgttgatgagcttcatcttccatcactccacattctggacctgctcccgcatcttctccacttccgccttcagccccaccactacattggcaatggccacatcgttgcacttggagccgatggtgttggactcccggttgacctcctggatcaggaagtccatcttccggcccatgggctcgtcgcttgccagcatggtacgcagctgggccacgtggctccgcaggcggacggtctcctcgtccacagccaccttgtccgcgtagatggcggcctccatcaggatccgctgctcgtcgacggtggtgctctgcagcacctcctccatccgggcggtgagcttggcgcggtactccgccaccgtctccggcgaccgcatctccacctgtccggtgtagcgctcaatggcgtccagccggttggagatgtcctccgccagcttctgcccctctacggcccgcatgtcattgtacgcggccagcgcctcgtccaagaccgcgcagaggtcggcgctgacggtctccaggtcctcatccgccttcgtgacggtaaggacgtccgggaaccgggccagcgtctccggcgcgggccgatagtccgctgtgccgcagacgtccgacagctcccccagggcggcggcatactgggccgccagctcccggttcaccgcaaccttgaccacatccgcggcagtggcgtccacggtgatgaacacgtccacctttccccgggacaccgcctgctggacgtgctttttcaccgcgtcctccgcaaaggcatacatccggggcatcttcacggtgcagtccagataccggttgttgacggagcggacctccaccgtgatgtcccgcttgtgcagctcctgtcttgcccggccgtagccggtcatgctcttaatcatgtgatccctacttcctctcttgtggtctctcagcagcagaaccaatagccgccgccattgcagagcgcccagagacagcacaggctcatacagggatttccgccgcaaaaggtgccgaaactcccgccgccggggcggtatgccgtgtcgtccgtgccctccatatactccagcgcctgccggtactcggcgttggtggggtccatctggcaggcggtccggtagtaccgcagcgcctcgtccagccagccccggcggtagcagaccgcccccttcaggaagttccactccgcattgtggtcgctgtaattggccagcagcgcctccgcccggctgatgttgccggtgttgatggcgatgcgggcctgctggagcacggagctctgaccgctgtaactctgggagcccccatatccgccgtagccctgatagccgccgtatccgccgtagccggaagcgccgtaagaggccccgccggagccactcccccgcttgccggaggcccgctccttggtgatctgctcgtaggcggcgttgatctctttcatcttctcctgcgccagatccgccagcggattgtcgtggtagttatccgggtggtacttccgggccagctcccgatatgcttttttgatctcctcgtcggaggcgttctccgacacacccagtatctgatagggatcgttcatgtggtctcctcagccttcttgtgtttctttctctgttccctggggggcattttgtggaaggtgccctccagcacggcccggcccacggcaaaaagcccggtgtacaccgtactctccagcagggggcgccagacgccgaagtcccacagctcaaaggccgtggcgatcatgtggatggagtggtccagcgttctggcaaaggcccggcggctctcctcgtcccatttgccgtcccgcaggccatagcgcagggccacgggattataattcccggagacggcgtctttttgcaggtcgtccgccgcgtcgatcagatacacccaccggcccaggtggtagagcatctgctccagcacccgccgccgcaccgggtcctccaccccggcagccgctgccgccagcagctgggcaaaggtatctgccgcctgatccatggagggacaacactccccctccaagcggctcagagccgccagctgttcccgcacccggccgtcaaaccccggccgggccgcggcagcctttcgatagccgccccgcagtgcggcggcggagacccggtagcccaaccccttccagaggccgtggtcctccacgccgtcccgcagctgccagtaggccagaatcacgctctcatccgccgccagctccagagccgcggttgcgggctggtacgcccggagccggacggggctggacacgcaccgcctccggcagggtgcagcttcttccggatccgacagcaggatggccagataggtgaagtcgtagttcaggatcatccgggccgccgggccgtaccgctcccccaaggtgtggcacagcccgcagtatgcccgccggaaccggtctgcctcctcctgaggcaggatctccagcgggggcgtacatagccgaacaccgcctcagaacacccggacgatgttgaaggtcaggccgcccctggcccgcagcctgcggtcatagaagatggcaaagacgatgcccgccgcgaatccggccgcagccaccgcgtactgcgccgccacgctgtccgtcagcagggacatgatgacataccccgccaggaagagcaccaccgggatcaggtacaccagtaccacgatccgcagcatattcttggtgctgctctccacaaccaccttctgtccgggccgggcgccgatggggttgctggcccgggcgtggaccgccgcgccggtgacgccgcagccggcgcactcctcgcagtcgtgtccgcaggcggatttccggggtacggaaatctccgcgtggtccgcatctaaaattcgttcaactgttgcgatctgcgtcatgttgtctcgtctcctgtatctggggtctctccggcgggcgtatcaggctccgccggctgatcggatgtctgttcagaaatggtgacacgcacctgatacgtcccgccggagacgcccacgtcgtgccccaccaccgtcacctccgcggggacagtgtaggtgcccacggcggagccgaagtccgccagatccaccgtcaccagaatgttgtccgaggtaatggcccccacatccccgctggtgccgaagatggacacggccagctgctctgtcagcaggtctacggtccggtcctccggcgcgttctccagaatgaagttggtggccgtcaccgtggtgcgctgcatatccttgaaggagatgcgcagcgtggcgcgtgtgacgccgctgagattctcgcatccctccgggatgggaatggcatagctgtaattggtggtgctgcccagctccgccagattgaaatcgtccagaacgatgctgtccatgctgttcagcacatctgccgggccggacaccaagatggtggacggctcgatcccccagtccacgttgtacatgcgggcgccggcggactccacgaagttcatggtcagctgcagctcccgggtgacatataccggcagcgtcacctgaatggtctcctctgtggtctggaggctggtgttctccagcagctggtcgtttgcgtcatagaactggatgggcagctctcccgtgaccgtggaggtggcgtcctctcccagatccagggtcaccttggcatagctgacggcatccacatcctcctgatcgccccggacctcgatctccgtggggctgacctgcagctctccggcggagtaaccctctgccacattgccggagatctcgcaccggacatccaccgtcttgtggtacagctccgccacgttgatggtgatgacggagggcgtccggtcgctcaccgtaatattctgccggaaatactcttccgtatagccgtaaatcaccgaggtcaccgtctgcacccctgtccggctcacgttggagagatccactgtcacccggatatagtctttgtccagcagagccaggtcaaacgcggtcccttccatctccaaatccacggtgctgacggtatcctcgtccagcagcatgaagccccgctctgtaaggaccgtctccccagtgtaggtgatgggcacatcccggaaccacttggtatgcatcaccgcaccgccgttgtttccgaagttgtccacgaagatccacaccacgatggccgccaggatgcacagggcgagatacaccgccttctgcttgggattacttttcatggttgtcgcctcccgtgcttccggcccgcagcagattcatcaggctgaacttgggcttgtcctccccggcctcctgcggaagcaactcgttccgcaggatattggccagcgtctccggcttgaggtgccgcttgagcattcccccgatggccacggagatggacccggtctcctcggagacgatgaccaccacggcgtcggcgttctcgctcatgccgataccggcccggtggcgcatccccagctcccgggagaggttcacgttcttgctgagaggcagcatgcatccggcgccaagcacccgcccgttccggacgatgacggcgccgtcatgcatgggagcctttacaaagaagatgtttttcagcaattcgctggagaccgccgcgtccagcaccgtgccgctgcggaccatgtcgtccagcaggttttcccgctcgaacacgatcagggcgccggtgcgggactgggacatctcggtgcaggccagcaccgtctggtcgatggcctgttccacggcggtgccggcctccgcccgggagaagaaggcgatgaagcggcggctgcccacctcctccaggatgcgtcggatctcgggctggaagaggacgatcagcgccaccacgccccacctcaccagctggttcatgataaagttgatgctgttcatattcaggaccatggacagcatcagcgccgccagaaacaccagcacgcccttgagcaggctggcggcccgggtgctctgaatcagcgtcagagccttgtaaaacacaaacaccataatcgctatatccaaaatgtccgtgaccttcagcatcatcagataccggccgatgatcccgggcagtgtggagagcgtgacaaattccattggacgtcatcatccctttcaggccatgaatatctagattatataaaatctgcctgtagaatgcaaggcaaaccaagctaaaattcacggtctgttcagaaagtcacctcaggatctcccccatagccactaggaaacgggatacttcctcccgcgtgttccagtgggaaaaactcagccggacggtgccggtgtccagcgtcccggcggtgcggtgggccaggggcgcgcagtgaaggcccgcccgcacggcgatgccccggtctgccagggccgcgcccaatgcctctgcgtccatgtgctccgggacaatggaaagcacccccgcctgggccgccaggtctggcagggcaaacacctgcagtccagggagccgcctcaggccctccgccgcctggaaggtcagctgccgctctccggcgcagatggcctccggccccagctggcggacgaatcggacccccgccagcagccctgcgatgccgggcatattgtgggtgcccgcctccagccgatccggcaggaagtccggcatctcctgctggatagagatgctgccggtgccgccctccagcagtgtgcggacggggacgtccttcccgcacagcagtacgccggttccctgggggccgtacaggcccttgtggcccggcatggcgatgaaggccgcccccagggccgtcatgtccagggtcagcatcccggcggactgggacgcgtcgatgatgaagggtacctcccgctcccggcagatagcggcgatagcctccaccggctggacgaagccgaatacgttggacacgtggttgcagatcaccgcgtccgtgccgggcacgatcaggcggtcaaaggccgccgtcaccgctgcaggctgaaacaggggcgccgccgccacggacacctgggcccccagggccgccaggggccgggtgacagcgttgtgctcatatccggagatcacggctttcccgccggggggcaccaggctcttgatggcaatgttcaggccgtgggtggcgttcatggtgaaggccacctgctccgggttctccagatggtacagctccgccagctctgtccggcagtcgaaggcagcctccgccgcacgcatggcggcggggtatccgccgcggccgggagagctcatggtggccatggcgttccgcatggcgtccgccacagtccggggcttctggaaggtggtggccgcgctgtcaaaatagatcacggtctcacctcccggaacgtcccccgctgagtcaagaatatctgaacagggtccaaagattccctgtgaagggccgtcagggcagccgtcaggtcggagtccgcgatctgcacggcgtaggcgcagccccggtccgtcaggtcccggggggcccggaagatccggcttcggatccccgaccgggccagcgcccgctgcatccgctgggcataggtcaccgagcgggcgataatcaaatagtgctccacagacactcctcctctctacccattctatggtcgggaggcgcggacgtgcgaaaaggacgcgcccgaggcacgtccttttttcaggggagccgttccagcagcgccaccgcatgggccgccatgccggagctgtccccagtaaagcccagatgctcctctgtggtggccttcacattcacccggtccgcatccgtcccaagagctgcggagaggttcgcctccatctccgggcggtaggggcccaccttgggggcctgggcgatgagggtggcgtcgatgttcaccacggcccatcctctctcctgcagcagcgctgccacctgccgcagcagctccaggctggaaataccggcgtagcggggatcgctgtccgggaacagcttgccgatgtcccccagcttggcggcgccgcagagggcgtccattaccgcgtgggtcagcacgtccgcgtcggagtggcccagcagcccacagtcccaggggatctccacgccccccagcaccagccgccgcctctccgtcagccggtggacgtcatatccatgtccgatccgcagattcgtcatatccgatcctccctggcctgcagaatagcctccgccaaaatcaggtctaccggagtggtgatcttcaggttttcctcgtccccctccaccagatagacccgcttgcccagccgctccacggcggagcagtcatccgttatggggatgccccctcaacagccgcctgaagcgcggctttcagcagcgcgctctcgaagatctggggtgtctgcacagcccgcagggccgcccggtccagcgtctccgccaccgtgccgtcgtcccggacggctttgatggtgtccttcaccgccaccgccggggccgccgccccgcagcgggcggcctgctccgccacatcgtcgatgagctccggcgtcaccaaggggcgggcgccgtcctgcaccgccagcagctccatgccctccccggcctccagtgctgccagaagcaccgagtgggcccggctctccccaccccggatcaccttggtgcatttggtgatgccgtaggtcctgcacagctgggagatctccagaaagtcctcctcccgggcggctaccacgatctcgtcgatccgccgggccatctgcagggccgtcagtgtccgggccagtacaggaatgccgtccaggggctgcagcagcttgttcaccccgcccatgcgggaagaactgcctgccgccgccaccagcgcggcgcagcaagggcgctgggcatcccggaattttttgaaaaatgccatgatccgacctccctggaaatttctcctgaaacagcagaatgttcgcggacatggtccgcgaacacgttatctctggatctccggtgtctggagcatggcctgctccacacgccgctccacctcttcatagccgctgtcctctgccagcaccagctccgacagcaggatctggcgggccgtatgaagcatcttccgctccccattggagaggccccgcttccgttcccggaacatcagccccttaatcacacgtgccacctcgtacagatccccgctcttcatccgcagcagattttcccggtaccgcttgttccagttgctgctctcctccaccgccaaagacgggatagcggcaatcagggcttccgcctccggccgctggatgaccgagcggactccaatcgtctggctgttggcggtggggatcttcaacagcagtccacccaccggcattttgaacacatagtagtcctgtgtactccccgcgaccttttcctgaacgatggcgtcgatcacgccggccccatgcattggatgaacgaccagatccccaacgctgaacatggtaaactccttcccatttccgccgggcggtgactggaacccgctctctctatttccacttttctgttttcataaatttcattataccggcttttcagcagctttacaagcttattttgaaatttttttactatcttttccagtgccttacactttccgcagagaatcatccacccgcggcaagggcatcagctcctccagacacaggtcccccctgtacaaaagagccggacggcagatatgccgcccggctccggaggattttgttatctcttgttggaacggcgccagatgtgcatcttctccgcctcggcgatcagctcctcgcggaactgaggatgggcgatggcaatcaggccctcggcccgctcccaagtggacttgcccttggcgttgaacttgccgtactccgtcactacatagtggaggttggtgcgggtggcggtgaccacggacccctccagcagcgtgggccggatacgggacttcagctggccgctttttttgtccatgtaggaggaggagcagcagatgaagctcttgccacccttggacaggtacgcgcccatgacgaagtcctgctggccgccggcaccggagatatggtgaattccagaggactcagaggacacctggccgtacaggtcgatatccacggcgccgttgatggagatgaagttgtcgatctgagacacccgggcaatgtcgttcacatagctgacgggagcagccatgcactcagggttgttgtcgatgaagtcatacagcttctgtgtgcccgccgcgaaggcataggtctgccggccccggtcaaagggcttgcgcaggcccgtgatgcgaccggctatggacatgtccacgaaggcgtccacgtacatctcggtgtgcacgcccaaatccttcaagtcgctctcggcgatcatcttgccgatggcgttgggcatagagccgatgcccaactgcaggcaggcaccgtcacagatctccggcaccaccagtttggccaccgccatgtccacctcactggcggctccgccgccgcccagttcatccaaagcagggttctctccctccacgatcatgtccacgtcgtcgatgtggatgcagttctcaaacccgcccaagcacacgggcatgttcttgttgacctccacgatgacggtcttggcgcactcgcacacagccttcaggtgggagccgccgggaccgaaattgaaccagccgtgctcgtccatgggggccacctggaacatggccacgtccaggctcttgatgcagttgcggtaataccccggcagctcagaataccgcaggggatgtaataggagaagccctcgctcacggccttgcgctcgatgccgcccatgtgccaggagttccagcagaaatgctccgccgcattgggcacatcgaaaatggcgggcttgtgggtcaggataccgccccggatcttcacgtcggtcagctcgcccatccgccgggccagcgccttatccaaggcatccgccgagcagacgctccagccgtaatccacccagtcgccggacttgacggccttgaccgcctcgtcggccgttgtcagcttctgtttgtacacttcctggtagctcatgttgatcttcctcctgtaattcccgtttgttgtatgatgtcatcggtgttgtcttacattgattgtcaagagtataacataccagcccttgaaaagcaatccataccgtgaaaaaaatcacaaaattttcaaaaaaaggcaggcccctcaccggagcctgtcttttttaggtctggaaatccgtgcggattactcctccacaggagcttcttcctcctcagccgcgggagtcagcagggcgcggatggacagggagatcttctgcttctcctcgtcgatggccgtgatcttggcgtccacaatctggccctcggagaggacatcctcaggcttgtcgatgcgccggtcagcaatctgggaaatatggatcaggccgtccacgccgggcacgacctcggcaaaggcgccgaaggtcatcagcttgacgatgcggacagaggccacgtcgcccacctggtacttgtccatgaacacctgccagggatcgatgctgtgatccttcacgcccagggagatcttcttcttctcgggatcgaaggagatgacgtacacgtccatggtatcgcccaccttgcagacctcggcgggggtcttgatccggctccagctgagctcggagatatgtaccatgccgtccacgccgccgatgtccacgaacacgccgtagctggtcatggacttgacggtgccggtgtagtgcttgcccacttcgatgttggcccacacctccgcctgggcggccttccgggcctcctcagtgacggagcggatggagcccaccacgcgccggcgggcgcggttgacctcggtgattcgcagctggaccttctgcttcaccatggcagacagatcggcgccgcggggctgaccgctctgagaggcggggacgaatacccgcacacccttgacggacaccacgatgccgcccttgttctcctcggtgacagtgccctccagaacggtcttctcctccacggcctgctcgatgttctcccagaccttggcagcgtccagacgcttcttggacagctctgcgtagccctccacgtcgttgacgcggaccacataggtctcgatctggtcgcccacgtggatgatgtcctccgccttgacattggggtcgtcgctcagctcgctgagcttgatgtaggccgcctgcttggcgcccacgtccacctgcacttcggtgggggtgatggcggtaacgatgccggtgacccggtcaccgttatttaaagttttaaaagactgattcagtaattcctcgaaggactcctctttgccctcggccgccttgatttcttcgctcatcgttgcatatacctccttaatgatgcccgcaggcgtggaggcaccagccgtaaggcccgcaacagtacaaccattgaaaaaatccggcgagagctcgtccgcgcgttcaatctggaccacgcgggggcatctcctcaggcaaatttccgtcagatgtttggtgttggcgcttttacggtctcccaccacgaccatcacgtctgctttgccggcgatttctgccgcctcagactgacgttcatgcgtagcattacatattgtatcaaagatttttacgtttgtacactgtttttttatgattttccaagaagtttcaaaaagttttcggatgcaggtggtctgcgctactacggtaacagggatttcccgacttttctcatccccgtccagccaggcctccacggcctccggcccgtcgaacaccaggggctggcggcaccagctggccacccccatcacctccgggtgcaggggttcgccgatgatcaccggacgacggccctccgcctccgcctgggccactaggcgctggatgcggatcacattgggacaggtggcattgacgcaccggacgccccgggcctccagatcgtccagcacggatttcaattctccatgggatcggatcaccaccgtgtcccccgccgccaggccagccgggtcctcggtcttccggacaccccggcgggccagatcctccaccacgtgggagttgtggatcaggtctcccagcatccagcatccgccggtctcctccccggtctttgccgccaactccaccgcccgcttcacgccgtagcagaatccggcgctcttggccaaaaggaccttcatcgcgcctccttccccagggcgtaggagcggcggagcacctcgtcggcgatggcctggacctcctccggtgaaggccgacggctggtggcctccggccggtatgcctggccgaagatgatgcgggtccggcgaaagaggcgtttgttcccctccacgtacaccggcacgaactgcgccccggaacggatgccgatgacggccacaccacccttggcgggcagagccccctcgtgttccacccgggttccctccgggaatatcagcaggttgtccccgctcttgatagccttcagggcggttttcaccgcctcgatgtccccctcgccccggtcaacagggaaggcgcccagcttccgcagtacccagtcaaagaccttgttgcagaacagctccttcttggccatgatgtggagccggtagttcaccggaaccttcagcgccaccagcaccgggtcccagttgctgttgtggttgggacacagcagggcgccgtgctccggcaggttctcccgcccgatgatggtgaccgggtgaagaatccccgccaccaagtttaccagatagtagatgcatacgaaaaatccattcaacggcctcttttcgctcatagtcccgtcctctcccggataatgtgcagcagcgcgtcttcgctctggacaaaatccagagccgtggtgtccagcagcaccgcgtcctccgcctgacgcaggggtgcggcgtcacggtgggtatcgttccagtcccgttcctgaatggcacggaggatagccgcataaggctccggcgtcccccgctcctccagctccagcatccggcggcgggcccgctcctccgcggaagcggtgagaaacaccttcacctccgcatccggcagcaccaccgtgccgatatcccggccgtccatcaccacgctgttctcccgggccagctggcgctgcatctccagcaggtacgcccgaacctccggataggcggataccagagaggcgtagcgggacacctccggcaggcggatctccgccgtcacatccattccattcagctccatgtgctgcaggccgtccgtcccataggtcaggcaaatctccaggtccggcagcaccgccaccacggcggagcggtcccggggatcgatccccttccgccacacggcatagccgatggtgcggtagatggcacctgtgtccacgtataaaaagttcagtctggcggccacgctcctggccagggtgctcttccccgcgccggagggcccgtcgatggccacgcgaatgttctcactcatgcgttctcttccccttgtctcagcgcctccgccgcagcctgtcccgccgcccggcctgtggcccaggcgatctgcaggttgaatccgccggtataggcgtccacatccatgatttctcccgaaaagtataatccctttacaagttttgattccattgtctttgggtcaatttcactgatctttatgccgccggaagtgacgatggcgtccgttaccgggcagggtccggcaatctccacagaaaaatgcttgaggccctggaccagttcccgcctctgctctcgcgtcaggtcatggaccttttgatggggcgggatgcccgaccgctccactgccaccggaatcagcttctggggcagcagatcgtccagcgcgttgcagaagtcgtggttggcgtacttctcaaagtcccgcagcagccgcttgtccagggcctgctcatccagggcgggcttcaagtcaatctccagccggtaggtctttttgccgaagtgccgcatgtgggcggaggccgacagcaccaggggcccgctgacaccgaagtgggtgaacagcatctccccgaagtccgtgtagatcttcttccggtcctcaaacaccgccagccccacattccgcaggctcaggccctggagctcccggcccaggccgtaatcccgcagcggcaccaaagagccctgaaggtccgtcaccgtatgccccgcttcccgggccattcggtgcccctctcctgtggagccggtggcggggtaactgacgccgccggtggcaaggactaccgccccggcagggtatgtccccgctctccccggacacctgtgacggcgccggaggtgatctccagctccgtcgcccggtcccgggccagagagaccttcagcgccttcagccgccgctccaaagcggcgctgacgtcaaaggcccggtcactgacgggaaacacccgattcccccgctcggtcttcagcggcacgccgatggacgcaaagaacgccatggtgtcccggccgtcgaaccgggaaaaggcgctgtacaaaaacttgccgttccggggcacgttggccagcaaggtctgtacatcggcgttgttggtgacgttgcaccggcccttgccggtgatgttcagcttctttcccagccgctcattgggctccagcagcgtcacccgtgcgccccgctccgccgcggagacagcggccatcatcccggcggctcccccgccgatcactaccagccccttactcatcgtccatcttcccgaacacgccgtaggcgttccagatgtcctccagctccgcaaaggtgcgggacacgtccgaccgcatccgggagcccacggcgatcagcagcgcgttgatgagggacagaggcgccaccatggagtccacaaaggagatcatctcactgggagccagcagagcagcctccgccatctggtagacgggggacagctcattgtctgtaatggccacgatggtagccccccggtcctgggcaaacttcactgtgttcatagtgaccttggagtaccgagggaagctgatggcgatcatcacatccccggggccgatccgcagcagctgctcgaagatctcccctgcggcgttggactgcaccagcgtcacgttctcggacagcaggtgcaggtagaagttcagataccccgccacaaaggaggaggtccgcacccccaggatgtacaggtgcccggcgcccaggatcaggtccaccaccttgttgaactcagtcctgtccgcctcttccgccaccatccgcagcttgtccatatcggactggatcacggcggacagcacatcctgtccgccgaacagattgtccgccgcctggatgcgctgggtggaagtgaggcggctgcggatcatctcctgcagtgcccgctgcatactgggatagccgtcgtaccccagctccgatgcgaagcgtaccactgtggactcgctgacgccggagagcttccccagcttgctggcagtcatgaaggcggccttgtcgtaattctgcaggatgtagtcggcaatccgcttctgtcccttggaaaaggtgggcatattgcgctcgatggtatgtaggatgctcttagccactgctgtttcctccgtcggccgcctgcagggggccgttcttgatcttgcccggcagctccgctggcccgccggacgttccgcggtctattgtagcacagttttttcaaaattcaaaccgctttgcgggatttttccgtctcgccgccggaatggaaaagacgccgccccattcagggcggcgccttccgcttttcagtcaggggtgactcccagcgccccagcctcgtcctgtgtcaaataccgccactttcccggcggcagatcgcccagctccagagctccctcccggacccggcgcagccgcttcaccgtcaggccgcactgggcacacatccggcggacctgccggttcttcccctcatgaatggtcactgccagcaccgcggttccgggagtttcccgcagcacctccacccgggcggggcggatgggctccccctccaggtcggtaacggctgccagccgggccgccgcgccggccaccggtccgaatacggagacgtgatacgtcttttccacctcgtgctttggatgcagcaggtgctgggcccaggcaccgtcgttggtcagcagcagcaggccctcggaatccaggtccagccgtcccacgggataaacccggctcccgcagtccgctaccagctccgccactgtccgccgcccccgctcgtccgagagggtagagacatagccccgcggcttgttcagcaggatgtacacggcctccgcccggggcgccaggggacggccgtccaccaggatctcgtcccgatccgggtctgcacgctggcccagatgggcggtctggccgttcaccgtcacccttccggcgatcaaatatgtctctgccgtccgccgggagcaaacccccgcggcggacagcagcttctgcagtcgttcttccatgttgtcctctctctatcccggcaacccctgcttcagaatgctcagggcgctctccatccggggcgccacgtcggcgccatacagcagcgccacccggcccacctcttttccattgaccgagaaaaccgcctccccggcccgccggccggcccggatgggggcccgcagagatccggccagctccacgtccagctccagggactccccctccgccagcggccaggcgaagctgtccgccgccaccaggggcaccgtggcgctcatgccgttttccacctggacccgctggattgtctggcccagagaggcccccagcttggcgggataggtggaaaaaccgtagtcatacagggccgcgtggtccgcccagtcgttgccgtcctggagagtcaccgccaccagccgctggccgtttcgctccacacagctcaccagcgtccggcctgccgccatggtatagccggtcttcaggccgatacacccctctatctggttcaacagcttgttgtggttggtcatggtccgcccgccaatggtgacgctgcgggtggaggccatccgtaccagagtctcattttccaccgccgcgcaggcaagacgcgccatgtcccgggccgtggagtaatggtcctcatggtccagcccgttagggttggcgaaggaggagtgctccatgccgatctcccgggccgttgcattcatgagctttgcaaagtcctcctggctgccgctgatgtgctcggcaatggccacggccgcatcgttgccggagcagagcaacagtccatacagcagtgtctccagcgtcagcttctcccccaccttcagatacatggaggagccctctgtatacgccgcctcccgggagactgtgaccacatcgttcaggtctccctcccggatagccaccagggccgtcagaatcttggtagtgctggcgatcagcattttcgcgtcggcgttctgctcatacaacacccggccgctgtccacgtccatcaaaatagcggaggaggcagacgtactgaccgcgtgcgtctgacaaggaaaaagactgaacagggccgccagagcgatccccaaagcggcaagccgccggagcagggtttgcaaatgccatcacctcatttgtttggtgatggtagtataccccgttcagacgggttctttttcttccttcttgtcgaaatatttttccactttgtccaccagatccggcatcatctccaccacccggtccagcgtggtcatgggcggcatcgccaccggcagcacccgggtcgttccctcccggatcaccaggaacgccacaggctcaatcttcacgcctgcgccgctgccgccgccgaagtccttgggctgggtcttaccgtagtcggcgccgccgcagccgaagcccatactgacccgggaaatggggatcagagtcacgccgtcaggcgtggtgatgggctgccccacgatggtgttggtgtccgccatctcccggatcttgtccatcgtggaacgcatcaaatcgctgaggggtctcttcttgtccattgtctcgtccatggatgccatcctttctcgtcacgcggcggggtgttctgccgccttgttgtctgctgctttggatgcgggcggcatccgccgccgcttcatgaaccgccggagccagccgatggccgggaccgccagctgcgttcccacggcgatcagcgtccccagccggatggagatgccaagctctccttccgcccgggtctcctgcgcgtcaaaatcaattccgagatgaatcccgggatcccggatcaccaccagcttctccagagccggcatcccggtccagaccagggcgtggagtccaccgtacaactctgcggctgccgccgggtcctccgccccgcccagggtggcggacaggcgcagcgggtctacgcggataccccgccgggtgcggcgcagagcctttttggcggcgggccacagcgtccttgcggcgtcctgaagatcttccagtttgggcttcgggattttttttgccgcctctgccaggtccttcggctcctttttaggctttcccgtttttttggtttcctgcggcgttttttttgtctctttggacggtaccagccggacccggaagggaccaatcgtcaaatccgccgcggcctgccccctgccgaagaccacatacagtcccagccgcagccgccacagaaaaatcgcaagtgccagcagcaccgccaacgtgatccaaagtcccagcaacgtccatcacccccctgaccgctctggcggagcggattctcaaggcgcctcttcctccatggcgccggccgtctccggcgtgtcggctccggtgatctctgccgtgtccgccgggtccatgatctgtccgtcctcgccgatccgcatctgtccctcgccgccaaggtccggcagctccggcaggtcatccaggctggtcagatggaaggcccggagaaactgtttggtggtccggtacaggcggggccttccgggtacctgcaggcggccgcactcctcgatgagcttccggtccagcagcaggccgatggtataggcgctgtccacaccccggatctgatccacataggcccgggtggtgggctggtagtaggcgatgatggtcagcacctccagcgccggctggctgagcttggcgggcttgcggatctcaaaggcttttcggatcacatccgcgtagtccggcgcggaacacagctgccaggtatcctccatgcgcagcagccggatgccccggcgctcgtaggcatagtagtccatcagcttctggagcacctgctccaccgtggggcggtccatctccagggccacgcagatccggtcggtctgcaccggctccccagaggcaaacaggataccctccactgccgattcgatctctttcatctccatcttggaacggtcctctctcacagtttcagatcctggggcaactcccgctcctgccggacagtgcagtccgtctcactccctgccagatgcaggatgtgggcccggcacagctccagcaccgccagaaaggtggccaccacctcgctgcggctgcggctgccccgaaacagcagcagaaaccgagtgacgccgtgagtccttagccggctcagaatctcccgggccttgctctccacgggatagggctcgtgctggacgatgctctggaaggcggagcggggcggcggcagggaccgctccgcccggccctggatctcggccatggccaagaccaggtccgccggtgtctggtcgtactcgtagatctttccccgcttcaccggctccggcggacgggtgaggatattccgtccgaattctcccatgggctccagccgggcggccatggacttcaccttggcgtagttctcgttgcgcttccgctcctccagagaggcgatcagggcatccatctcgctctgggcctcctcatcttcaatggagagaagcatccgggtcttgatgtacaccagttgggaggccatggtgacgaactcgctggccacctccagatccatctcctgccgccgggccagccacgccatgtactggtcgcagatcagggagatggagatgtcctggatctccattttgttcttgcccagcagatatagaatcaggtccagagggccctcaaagtcctgcatctcttcctcggatttgctgcggaccaccttttccagcttgaatacggggttttgcaaaccgttcacctcaaccaaaaatcagggacaacagggcactgtaaatgcccaggatgccccgggagatcaaactgctgccgatgcccacaaaggacaacaccaacagcacgacaatgccgtaccgctcataccgcatcagcgtgatgtactgccggtccggcagaaacgccgccagcaccttggacccatccagcggcgggatgggaatcaaattgaacaaccccagaccgatggacagaggcgccagcgtgtacaggcagaagctgaacaccacgtccatcgccgcagaataaggggcgtaaaggtaaatcaccttactgataagcattgccaaaaccgccagcacaaagttggagacgggtcccgccagggcggtcaatgccatgccctgcttgggctttcggaagtaccgggggtccaccggcaccggcttggcccagccgaatcctgccacgaacatcatcagcaggccgatccagtcgatgtgccgcagaggattcagactcaggcggtgcatggatttggccgtggggtccccaagagccagggccgccagaccgtggcaagtctcgtggactgtcaggcagagaaaaatcgcggccacccgcaacaccgcgtccagcagtgaagtcaggtccagcgcggaaagcaatccctgtaaatagtgcagcatattcgtctccctgtgatgataacccaaaagataggagtattataccagttttccccccgcaatacaaggaaaatcaccggaattcaaagggctttcaggcggaaacaagcggagcgggtgctttcgcacccgctcctgattcagctggcttaataatcagcccttcaccatggaggcgatctcctcagcgaagttctcctgcttcttctcgatgccctcgcccttctcaaagcggatggcgtccttgaaggtcacctttccgcctgcggccttggcggcggaggcgatatactgctccacgctcatggagttgtccttcacgaactcctgctgcagcaggcagttctcggagtagaacttgttcagcttgcccatgacgatcttctcccgcacggcctcgggcttggaggccatcttgggatcgttctccatctggaccatcatgatcttcttctcctcgtccaggacgtcctggcccacctgagacttgtcccagaagcgggggttcagagcggcaatctgcatggccacgtccttgccgatctcctccaccttctcagcgggcaggtcggactccaggttcaccagcacaccgatcttgccgccggcgtgcacatagggcacggagacgttctcggcgaagcgggcgaagcggcggaccttgatgttctcgccgatcaccagcaccatctcctgctgctgctgggtgacggtcaggtcggtgccgacgtacttgcactccatcagcgcgtccaggtcggcgggagcctccttggccacagtggcggccacgcccttgacgaagtccacgaacttctcgttcttgcccacgaagtcggtctcggcgttgacctcgaccaccacgcccacgccgtcgatgacggcggcataggccataccctcggcggcaatgcggccggccttcttggcggaggcggccatgcccttctcgcgcagccactccacggccttgtccatatcgccgtcggaggcggtcagcgccttcttgcaatccatcatgcccacgccggtcatctcgcgcaggttctttacatcagctgcggtaaaagccattttgaattcctccaaacagttttggtatatacgcgcaaatgcaggcgcagattactcagcgtcggcagcagcctcttcagaggcggcctcagcggtctgctcaccctgcttgccctccagcacggcgttggccatgatggaggagatcagcttgatggcgcggatggcgtcgtcgttgccggggatcacataatcgatctcatcgggatcgcagttggtatcggcgatggccaccacgggaatacccagcttgtgggcctcggcgatggcgttgcgctccttgcgggtgtccacgatgaacagggcgccgggcagcttcttcatttccttcacgccgcccaggtacttctccagcttggcgatctcgcccaggtgcttcatgacttccttcttgggcagcatgtcgaaggtgccgtcctcctgcatggtcttcagctggttcagccggtccacacgggtgcgcatggtcttgaagttggtcatcatgccgcccagccaccgggcattcacatagaactggccgcaacgggtggcctcctcgcggatggcctcctgcgcctgcttcttggtgcccacgaacagcagggactggccgctctcagacagctgacggacgaagctgtatgcctcctccagcttgcggacggtcttctgcaggtccacgatatagatgccgttgcgctccgtgtagatatagggagccatcttggggttccaacggcgggtctggtgaccgaagtggacgcccgcctccagcagggccttcatggatacgacgctagaatttgccatagttgtgtgttcctccaatttcaatttagttggtcctccggcggtttcatcccccctgccaacccggccgttttgggccccgggcacagacagaaagtcgacgcaccgtgcggaatgctgaaatatagtatcacaatccagtgtgcaatgcaagtattttttcccaaaagccgtgtaaaattcccggttttgtccgaatttgtccgagttccccagcagccccccatttgttgttgcgccgcgcctgtctgtctgctataatgaccaaaatcccattttcagtttatataaaaacgcggcagatcagaaaggagcacatggatggacactgaaaagcagaaatcatctccgggtggaacggttcccggtgaaaaggttccgccggtcctgatggcggaggatgtggcggcactggaggaactgtgcggagacgtctccggctacttttacaaaatgctggactacctagaccagcgggtccgggacggtgtgcgtcagggagagttcacggaggagcaggcccggggcgatctggatcttgccctgtggtacgcctatgcctgcaacaacatcgacgactatgactactattataaagctgcccagtggatgcccgcctcggaaccggcggcggaggcggccgggagcgggatctggtactatcgctacgcctgcgccctgatgtactgcggccgcttggaggaggcccggcattatgcggagaccggcgtgtccctggacccggagtatccctggggctggctggagaccgccaagctccgggctcacttcggcgatgcgtccggtgctctggaggcggtggaccgggggctggctctggtgcctggggactacgagttcaccaccctccgtcgggagatccaggagggccggactctggaggagatggagttccactggatcgatccggagtgcgacgcggttctgcaggccggcggagacgaaaacgaggcggaaaagcggctgtccatcgccgggatctgctgcgatccggagaacctcgccgccatcaagaccgccctctcccccacggagtgggaggcggacgccccctactgcactttccggctgccctatcagaacggcagcctgctggggcgtttcttcatgaacgaggcggcgctgtccaagtttcccctctcctgggtccgtgagtttgtgcgccggctgccggagctggaccgccggggccgaaccttcctggccgcccaggcggggctgggaacggagggactatccctggaatggttcgcggtccatccggaccggacgatgcgcctgtgttacatccgggggcaggaccagcagatggtcctgttcgacagggatttctccctttgcagcgaggaccggcagcccgccctgacccggccggagggcggcgccttcctggcctttgtcctactggaagcgcctgcctgggacccggaccagttccgccgggatctgcgggatctgtacggcatcccctgcctcacagaggcggaggaatctgaagacggcggcagcaccctgacctttgaggtcagtggaatgctggcggcggtctgcctatacccattccctgtgccccacggcgaggcggaggaaaacgccgcccacaactacctgtggccggaggcagcggaatctgctgcccgccaccggggccagctgttggtgaccgtcctgccccgggaggaatccgtccgagaggcggccatactccaggtgaagctggtgtgtgccgcctgccgccagcgcggaacgctgggtgtctacgccaacggcaccgtgtaccagccggagttctatcttaacgcgtctcaacccatggaggacggggagctgcccctgctggatctggtgtggatgggcctctaccgccgggaagagggcctgtgcggctacactgacggccttgcggccttcggcaaggaggagatagaggttctggacacccaggctgccccgggtgacctgcacagcttcctgttggatctggccagctatgtattggaggaggatgtcaccttccacgacggggagaccatcggctttaccgaggggcagtatctgcccatctcccgcagcgccggtgtctggcacgacggcatgacgctgaagatcagctatccggaggagccgtgaccgctccgccggcatacgcaaatgcccccgcggtgaaagccgcgggggcatttgtcagcaacgcttgcgccgcttccgctccaggcggggatcccgccgctgaaagggcttgtcgatgaggatgatgtcgtctccgatccgctggatgcactcccaggggatgtagaactcctcccccctgccgaacaggccgaaaaagcggcccgggccgtagacgatgatggctaccacctgcccctccggcacccgcacgtccaggtccgacacgtagcccaggcggcagccgtcgcagacgttgatgacctccttgcaccggaaatcccggatcctgcactgcaccgcgctcaccccctgccttgagactatgcagtggacggaatgtcccaacactgttttatgcagacgggcagaaagcgacaaaagcttccagtataggaaaaaagccctccggccatactgaactcatgaagtttcagggtttgagggggcacagccatgcagggcaaggtggagatcgcgggcgtcaacacggcaaagctgaaggtgttgaaaaacgaggagaccatggaactcctgcgccgcaccaaggccggggaccaggaggcccgccgggaactgatcgagggaaatctgcggctggtgctctccgtcatccagcgcttcgccggccggggcgagaacgccgacgacctgtttcaggtgggctgcgtggggctcatcaaggccatcgataactttgacatcaatcagccggtgcggttttccacctacggcgtgcccatgatcatcggcgagatccgccgatatctccgggacaacagcgccatccgggtgtcccgctccatgcgggacacggcctataaagtcctgcaggtccgggacaagtacctggcggaaaaccagcgggagcccacggtggaacagatcgcccaggagctgggcatcccccgggaggaagtggtcttcgccatggacgccatcgtggatcccgtgtcgctgtacgagccggtatactccgacggcggcgacgccatctgcgtcatggaccaggtcagcgacacccggaacaccgacgaggcctggacggaccgcatcgccctgaaagaggccatgaagcggctggatgaccgggagcggcgcatcctctccctgcggttctacgagggaaagacccagatggaggtcagcgcggaggtcggcatctcccaggctcaggtgagccggctggagaagggcgccatcaacaccatcaaaaaaaatatatgagcaggcggggccgggaaaccggccccgctgtctttacgtctcagaggcttctgttgtctccgtcggtgagagcccgttaaagaagctcccgccatccgacaaagtgaatgtcttggacaggcccgcggcgctctggccgccctctccgccgccggggccgcggccgcctgcgggagattccctaccgtcaggctccatttccccatccgggcgctcagggggatcgtccggaacttcactgccagcgttctccggcacctcgccctccggcgcctgccagggatccaagtccgcgggaggcgcctcaccgcccatgtgccgaccgccgccggggctgcccacgccgtcggacatggtgccggccagttgggtgtctccctgccacagggtgtagtcccctgccgtcaggtccggggaggacaccaccagacaggtgaagtcgtttgccggcgtccaggtgcccacagtctccccgtcggcgttttgcagggtataggtctggccgccgttctgccgggatgcaaaggagaacaccacatagttctgggccccgccgtcgatttggtcatacatattgccggaggccgctactgtgccgccgttgatggtgatgcccatggtggcgtcgatacccgcgtccccgctgtcggagcaggccgcggcggtgacggcgccgccgttgattaccagccagccgttggagtcgatgctgtcgccttcgccggtctcgccggcgacctgaatgttcacggaaccgccgttgacagtggtgacggatacattgtcctcattggtgttgatgccgtcattgccggaggtgatgttgatggtgccgccgttgatggtgaggtgcagctccgtgtccagcccctcattgtcggcggtgatgttcagcacaccagtgccggcctcacccccgtccacattcatggacatcttggagtaaaatgcgccgtcgtatttgtggagcttctcgctgtcctccacggtcattccgtcctcgctgagcaccacgctgtccgggtcgtagatccgggccacataggagccggtgacgttgttgatagtaccgtcagcaatcagcacgttggcaccggcggcggaggtgtccacggtctccgaggcggtgtcctcgtctgtgctgccgcactcatagacgttatagaaaatcaccgccggggccacagtgcaggtgatgtccacgccgttcaggatcagcgtcaccactgccgccgggtcgtcctccgcgtcctcccccaggtccacagcgatctgtcctgcggacagggtgccgctgagggcgtaggtgccgggttgtgtgatgtggaccaccgtgtgggcctccgcctcttcggcggtgtgttcgtcggcctccgtgccctcgccgtaggtgaagtcgcggccggattcatagcagacaatgtcatgggccgtgtggacggcggctgactcgtctgtggagaccgccttcccgtccacaataatgccgtcatccgagaggacgatggaaacagcgtccggaaattcctgcgcggccgtctcgcggccctgcgcgccgcagccagaaagcgcggccgcagccatcgccagccccagcaagagagaagcaattcgtttcattgcagcaaatcctttccgtcaagatggaggcagtctatcatggatttctgaatttccactgaaaaaaggaggaaaaaaattgaccttttcacaagttcggagtaagctgaaagcaagtcatcaaaaacgaggagaccgcacacatggactacaaaaagctcagagacacccggaacagctccaaccccttcgcccagcggctggggatctttgtggaggagatcggccccggctacgcccgggcggtaaaggacatcacggcggaggacgccaaccctgtgggggttgcccacgggggctgctacttctccctggcagacacggcctgcggctccgccatggcctcccacggatattatgccgtgacggtgaacgcctcctacaactttctccgcagcgccaagctgggggaccatctggtggcagaggcccgggagaccaagcccggccgaactctctgcttttacgaggtggagatccgggaccaggcggggacgctgctggggaacggatccttcaccttctacaagctggaccgggagatcccgctgtgagaagcgcatacaaaaagaccgcccttcggcggtctttttgtatgcttatttcttgaagctgtccttcaagctcacagatcggttgaacaccagatggccgggcttggagtccttgctgtccaggcagaagtagcccaggcgcatgaactggaagctggcgggagctgcggcatccgccagggaaggctccaccttgcagccggtgaggacctccagggagttggggttcaggcactccaggaagttcttgtcggccgcgtccgggtccgcgtcggtgaacaggttgtcgtacagccgcacctccgcgtcgatggcggtggcggcatccacccaatggatggtggcacccctcaccttccggccgtcagcggggtcgccgccccggctctccgggtcgtactccgccagcacctcggtgacgctgccgttctcgtccttcacgcagccggtgcagcggatgagataggcccctttcaggcggcactccggtccattggggtagagccgcttgtacttgggcaccggggtctccaggaaatcgtcggactcgatccagaggttgcgggagaaggcgatctcccgggtgccggcggcggggtccagggggttgttctccacggtaacagtctcacttttcccctccggatagttggtgatggtcagcctgatgggccggatcaccgccatggtccgctgggcggtctcgttcaggtcctcccgcaggcagtgctccaggaagccgtattccaccacgttggcagactttgccacaccgatgcgctcacagaagttccggatagaccggggcgtatagccccggcggcgcaggccgcagagcgtgggcatccggggatcgtcccagccggagaccctcccctcctccaccagcttgcggagcttgcgcttggagagcaccgtgtggtcgatgcccaggcgggcgaactcgatctgccggggatggctgggcaggtcacagtgctctaccacccagttgtatagggggcggtggttttcaaactccagggagcagagggagtgggtgatgccctccagcgcgtcctgaatggggtgggcgaagtcgtacatgggatagatgcaccacttgttcccctgtcggtgatggggcaggtagttgatccggtagagcaccgggtcccgcatattgaagttgccgctggccaggtcgatcttggcccgcagggtgtacttgccctccgggaactcgccgttcttcatccgctcgaacaggtccaggctctcctcgatgggccggtcccgccagggggagcgggccggagtggtggtatctccccggtactccttgaactgctccggcgtcagctcgcagacataagccaggcccttcttgatgaggcccaccgcctgacgataatcctcgtcaaagtaatccgagccgtagaagaaccggtcgccccagtcaaagcccagccagtgaatgtcctgctgaatggcgtctacgaattcctcgtcctccttggtggggttcgtgtcatccatccgcaggttgcacaggccgccgaacttctccgccgtgccgaagtcgatggtcagcgccttgcagtgcccgatgtgcaggtagccgttgggctccggcgggaaccgggtgtggacggtcatcccctcgaactggccgccggggccgatgtcctcctcgatgaaagcgtggataaagttccggctctccggcgcctcgtcctgcgtcagcttgatctcctctgccatgcgctgtcattcctccctctcgcgcagtgtatcgttggtatgcgtacacgttaggatatttattatacaaaatctgacggggaaatgcaatacgttgttttagacggccattggcggcatggggacagcaaaaacttgtctgtatgcgggaatatgtcaaaagcgatcacatattcacaaaacggagattgacctctcctcaatgcccaaaagcgggatgcgccggcaccgtatcattaagataaacctgccgctggcagcgcctttggcgaaccggcaggacagttgcgttctttcgccggatctggtacgatacgaaaaaaaggccggcgtctccggcggaaagagagcgtctgtatggaaccgggattcatcgatctgacggcggaaaacatcgccgatcagcacctgtgctgcatcatccgcagcaaaaagccccaccccggcgtggaggctaaacgccgatggctggtggaccgcctgccggaggggcacgtcttccggaaactggatgtcaaggaaaaggtctttatcgagtacgcccctttggagaccgcctgggtccctgtagagggggacaactatctgtacctctactgcctctgggtggccggtgcatacaagggcaaggggtacggccgggcgctgatggagcactgcctggcggacgcccgggaccggggaaaatccggcatctgcatgctgggggcggaaaaacagaaggcctggctctccgaccagtccttcgcccggaagtacggctttgagacggtggatgaaacgggctatggctacaccctgctggcccgatccttcgacggtaccctcccccgctttacggaccaagccagggcggggaccatcgaggaaaaggcgctgacgatttattacagtgaccagtgtccctatgcggtcaacagcctggagatcatccggcaggtgtgtggagaggccggggctccgtattctctggtgcctgtggacacattggagaaggccaaggcccttccctgcgtgttcaacaactacgccgtgttttacggcggtgccttccagacggtgaacctgctggacgccgcttctctacggcggctgctgaagcggtaaagctgcccttttccgccgccgcaaccgattgttgccggatagttggtggtcaaaggagttgaattctggtagcataaagtctgaaaggaggtgtgtccatgaccacgctgggtcagcggatcagggaacaccgccgacgggcaggcttgtcccaggaggctctggcccgccggatggatgtcagccgccaggcggttaccaaatgggagtccggccagagcgcccccagcacggagaacctcttccgcctggcggagctcttcggcaccacggtggacctgctgctcccatcagagggggcggacgctccggcggcagaggcacctccacccctgtggtcccggatccgctggcgtccccgggtcctggcggctctggcggtgactgcggggtatcttgtcttttacctgctgggccgcatcctctggtgccccctggaggacagctccctgctgggctggctgctgtgggagcggcccagcggcggggagagctatctctacggctggctcctcagcagcggtctcttctggtgggccatggccctctccgccctgacggcgctgctggggtggtaccggctctcctgcaccacctgcgcctattttctcatcggatttttgatggggctggttctggggccccacccgccgggagcggccatgggacacgggcactacggctgggccttctggggatgcatctatctgctgtccctccccatggggctgctggcggaacgggcgggacggaagggcgtgacgttcgcttcccgccggggacggctgctggcggcgggactggtcctgtgcccgctcctgtccgccgttctggcggcgttggcaaaagcgccctgaaatttgtaaaaagagtccggagagaatgcacaccctgcatcctctccggactcctttttacggccggactgcacgctattccagcaaccagtcctccaccacatcccgcgccgcgacgggcgtcacgctcccccgcatcagcttggacagcagcgacaggatcccagactgcgaggcggtgatccccgggatctccgtccgctccccgccgctctccacgcggatgccgtagcactcccagagggcgtcccactcctccaccagcagaaagtagtccaccggtacgccgcggcacggccttcttcctaccaggaaggcccgcacctcgatttcctccttctgtctgttgtcacacacgaacaaaaaaattgtagcactgccgtttgggggaatgctgtcgaaccctgtcgatggcccggcttcctcccgctttttactgagttttcaccattcgggaaaggaactcctcccggctgtataacaggttcaacgcctctaacatgccgttgggcgtcaggtgctccggcaggtccagctgcttcagcagcgcccggcgcttcgcggcgctgtcggttccgccggtgaggcccagggcgaacagatccgccttggtgatagggtctcccggacactccgtcgccccctcgtcggcgaaggtggcgcccgcccggcgcagggcctccagcagcacggcgggcctcataccctccacgcccagcttgccctctttgccgggggtccgcttgcggcgctccttgcctgggatgtccgggatatatgcctgcttcacccgatcctgtgggagggcacccttcagatagttccggatgacgaaccctgccccatcgctgtccgtcagcacgatgagccccctctgctccgccaggcggcggagaaaggccagcttctcccggtcgttgaacacggcgaagccgcccagtgtgatgatggtagcgtccaccacctgactgagggcgtttttgtcgtagcggccctctaccacaatgacctctcggatcgctttcttcatcgccgctgcgcccccagacgcaccagcagcagcttcagctcgcccacggcgtccacgcccttctcgctcttcatccgccggtccagcacctggcacatctgcaccgcgtcggcgcaccaggcggccgtggtctttttggcggcggagagcaggagtttggccggatagtcgctcttcatctcccacagctccatgagccagtacttgtccttgccgctgtcaatggccatccgggcggtatagatgcgccggagctggctgcccaaagccgccaggatcatgatgggctctgtctgcattttcagcagatcccccaggatgcgggccgccccgtcgtaattcccctggagcaccgcgtcggacaggcggaacacctccgccgacagcaccggatccgccacagcgtcgatgtccttctgggtgatggccctgcctttggcataggcgccgatctttgcgatctccggcaccagccccgtcatcagaccgccgcaggtgaagatcaggtactccgccgtctgacggtcgatctccttccccagggccttgaaccgccgggcgatccacaccaccaggtcgctgttgtccgccggacggaactccaccgcttccacgtggtcggtgacggccttgtacagcttcttcatggtgcggttgggcttgtattccaccgtgtcgtagaggaacaccacgcagcagtagggcggcacatcctccaaaaaggcgatcagcttttcccgctgctcctcgttcagcttgaacaggtcgaagtccgacaccacaatcagcgtccgctccgccatcatgggcatggcctccgccgtctctgccagggtctggaccgtcaggtccttcccctccagggtgtggtagttgaactcctcaaacccggcggggaccagcttcttccgcagctctttgagatagtactcccggagatacgtctcctccccgtagaagatgtaggcgttccccgccgttcccgcggccaggtcgtttttcagtttctgaaaggcctcgttggccttggatgtctttttcgcgtatgccatggtgtctcctcaattcacagatagatggacggtaccctgcttgtccgtccggtagatctccacgtctgccagcaccaggcggcggagggcgtcctccgtggggtggccgtagctgttgtcccccacgctgatgatgcccgtctccggcgtcagggcctccagcaactccttcgaggtggaggatttggagccgtggtggcctactaccagggcctcgatgtcgggcagatcatggtcggcgatcagctgccgctccgccgccatgttccggtccccggtaatcagcaggtcgtagtcgccataggtgcacaggacggccagcccctgttcgttgtcgccctccacgtcccccggcgggtagatggtgaggctgctctcccccagggtgtaaaccgtctccgcctccacgtattgaatgtccacgccgtggttccgggcggccagctccacccggaaccgcgcccctgcatcgtcggacacgtccggcaggagcagagtgtccacccgcgctcttgccagcagctccgccacgccggagatgtgatcgtagtcatagtgggtcagaatcagatagtccagcgtcccgcagcccatggtggccaggtgatccgccgcgatgccgccggcgtcgtaccagctgttgcggctgccgcagtccaccagggcaaatttcccgccggaggtcagcagcacgctctccccctgccccacgtccagcacataggcgtccaggccgccccgggtgtagtggggcgcgcccagccgcaccgtcaccgccagggataccgccgccagcacacccgccacggcatacttccgccgggccttgggccgcaggaaaaaggccgcggcgaagaggacatacagaaataccagccagtatttcagatacgggttggtgaagtacagggcgtggtgggggacagacgccagaaccccggatatccagaggatataccgggtcagcaaagccggcacgaagccgatcaccgtccccagaggcacccagaggaagctcgccaggactgccccaagccccagcgtgaacacaaggctggaggctgtcaggcacagcaggttgcttaccggagagatcagtaccagcgacccgaagtagacagcgcacaagggcaccgtgaatgccatggcccccacggtggccgacaggctggaaaccagcagtcggcagaccttcccactcggtctctcccccaacagcaggtcctggagcttcggcgtcagccagagaagccccgccatggctccgaaggacagctgcagactgatggaggccgccgcaaaggggttcgccagcaggatcaaaaacagggcggcggacagcgtggtgggcgggtcgctgtcccgctgaaacaggggtgccgccagcacgaacaccaccatgatgcaggcccggaccaccgagggactggccccggtcaacagcgtatagaacatcaggacgggcagcgccagcgccgccgccagacggtgccggtgccgtcctgtgagcagcagaatcagcgtcatcagaaagccgcagtgcaacccggacacggccaggatgtggctgagtcccgcctccgacaggtcggaccgggcttcttccgacaatccggacgtgtccccggtgaggatggcgctgaggaacgcggcctcatctccgtcaaacagcgccgtcacccggttctgcatggcccgggccgcatgggcgggccaccaccgtggcgagccggcggatccctcaccgtagacggcctcgtctccccgctggtaggccagcaggaacactccctgagcggtgaagttggtaatggtatcctcccgaagccgggcggaatcctgaaatttcacctgtgccgccaccgtctggcccggctccaggtccagcaggtccgccccgccgtagcagaccaccttgcccaggggaaccccctccagcttcactgtcaccttggcgccgtagtccgtggggacggcgtactccaaaagagtcatggaagcggtgccctcgctgccggacagggccgcaagaggcgcccgtacagcatagctgtacagccagttccaccccagggccagggccagccccgtgcccaccagcaacacccgcttccgccaaagtcccggcagcagcaaggcgaggcaggccgcggcaaagaaaactgccgccacgggcagaagaagcctctccggcagcagatactgggccagacagatccccagagcgaaggacacggtgaacgcggccagcttgcgcatggtctctcctcttttccatcctgccaaacagctcgtccagcggctgcccagaacagcgggcaggctgcaaaagagccgcaattttgctctctccgccggatccatgcataggccgccgggattcacggcacctgctccgttgccccgtgtcagccctttggccggacgcgctttctcccaatgattctgctttcccgcctcgccccagccgatcacagctgtttggaaaaatggggaaagagaaaccatttgggtacattataccgggaaccggcgggaaataccagccctttttccataaatcatgttccctgctcttgacggctctctccgcccggcgtaagatagcagtaatcagtggaaattcttccaccaaaaaagagaggagcgttgaccatgaaacgcattctgaccatactggccgcgaccttgttgctgactgcggcaatggccgggaccgcctccgcctcttcctacgactccgttgcggaggaattgtccgccatcggcgtgttccggggcaccgccggcggctttgagctggaccgcgcccctacccgttccgaggccgccatcatgctggtgcggctctacggcgccgaggacgaggccaaagccgcctatgaggcgggagagatctccatgcccttcaccgacgtgagcgaaaccgcggccccctccgtcgcctggctgtacagccaaggcatcaccaacggcacctccgccaccactttcggcgcatccagtccgtgcagcgcaaaaatgtattgcgccttcctgctgcgggcactaggctatgaggacggcgtggacttcctgtacgcagacacgctggacttcgccatgctccacggcctgttcaacctctccatgctggacgccgcccccttcctgcgggacgatctggctgccgtcacctaccaggccctgggcgctgatctcaaggacggcagcacctatctgctggccagcctggtggagagcggcgccattgacgccgaggccgcccggcccattaccgagaaaatcgaggcctaccgggccctgaccgccgccagccaggcctcctccaccggcatcgacgcggactataccatgaatatggggatggacattgccgttgacggctccgatgggaccgagaccatccacgaaaccatgtccgtggccgtctccggaaacggccgcatccagatgattctgaaagacccgctccagctggccatttccatgaacatgaacatggaatccaacacggcaggcgccggccccgatgtgaccatgcaggatcaagtctctgttcaggagtggatgcaggacggctgggtctatatccaggaggagatggacggaaccacagaccggtacaaatatccggttggcaacatggacgggttcgcggagttttaccaggagatgctgcagatcagcggccagatgaacagcatgatgctgcccatgatcgactccatcgacgtctcccgcacgggctcccgcaccgtatacaccatgaagatggatgacagcctgaacagccttctggaggatctgctgacggccttgcaggaagagcttgccgccatggagagcccggtggacctcaccgcagatctgcagagctgcacatacgtctacaccgtcggttccgacggagagctggagtcctgcaccgcggacttcgacctggatctggtgctgggcctgcctgtcacggagaccgaaaatgcgcagattactgccaagctccagatggatatgcagatggatgtcaacgccaccggcgatgatgtgcgcatctcttatcccagcttctccaactttgaggacctgaccccggtcctctccggcggtgagctgtaacccccccttctaattcagtaagagagcgccgcgagcaaagctcgcggcgctctcttatgctccaacggacggcaaatcaggaaattgaaatcattttgcctcagcggtacagccgcccctctcgaaggccgcatcagcccggaggccacgtcatatctctgccgctcagtacgtggaagtgcagatgaaacacgctctgccccgcctgcattccccacctggccaagcccggtgggggccccggataaaacttgagcgggcaggcaaagcccgcccgctccaaggttttgcttcgcaaaacgcttgcacgcgctctcgcgtgcggccccgccggggccgtggctcccaggcatcagcccggaggccacgtcatatctctgccgctcagtacatggaagtgcagatgaaacacgctctgtcccgcctgctcgccgatgttggagaccacccggtagctgtccagccccttttcctttgtcagcttggcaatgacctcgaagatatgagccaccactgtgctgttgtccgcggtgatctcagacacagagccaatgtgggccttgggtaccaccaggaagtgggtgggcgcctggggatcaatgtcattgaaggcgtagcacacgtcgtcctcgtagaccttgctgctggggatctccccggcaacgatcttgcagaataggcaatcggacattttcaaacctcctttgatgtgatcggtataaactgatgataaacgggatcgtagcgatagtcaacccccgccagcgtctcccgcagggactgctcgtccgcatccagggacgcgcacagatcctccaggtccgcatactggtcccggaggcgggcgttgaggaagctcagaagaatgtaggggtccttgggcagcagcatggcagccccctttctctgtaaagggaaaatacttgcgatattctgaaagtaaataattttaccgcacgggtgtgtagttgacggatgcttcctcctctgtggtctccagcttgaagatcacggggcggagcccatcgttgcaggagcagatggccacgccgggcctgcggatccagtcgccgtaatagaacagaccctctcccgccccgtgggccagggcgaacacatactgatagatagccttccaggcctcgtcacagaggccatccggcttggcgtagtcggcgtagaacacctggccttcccgcagcatggggcaggggcccagcccttcagcgccgtattccgccgccagctcttcatccagggtggttttcaagacggtgatcttgacttttttcatggatcgtcctcctggtaaagatcaaatgtgataggtggaaattcaaacaggggcttttccttcctctgcatcccccgcttgggcttctctaaccccagtgtgtcataatatgcgtcggagaaattcaggaccgacgggtcaaagcccgtctggagctccttcacccgctggaatgggtcccgggaccggatgtggaatgtctccgccaacaggtccagggatgcgtcccggctcttgaagtcctcctcgcagcccggccaggtgttggcatcgttgtcctccagaagcttccggaaccgggtcgcgtccagcatgaagatctgcgccagaggactggtacatttgcagtagaacagatgggaaaggaactcccggaagtccgcccccaccggcagcacaaaggtgccctcttctgccagctccggctccacgcagtacaccgcctcatcccccggcaggaggacgaagtgcgtcccgcaactgccccagccaatgatctcggcattttccggggtacagaaataccgtaccgggtcggcgtctgtctccggttccagctccagcatggagaagtccagaggcaggccgaaaaacgtcttgacgtcctctcgagttgacataaagttctcccactccactctgctcccgccaggcctttgcccggcgaggccccggggaaggtgtcatctacagcttacttcagcttttccgccacaaaatcatccacggtggccagtgcatcatccagcttcagcaggtcactgccgccgcccatggcgctatcaggcttgccgccgcccttgccgccgcagatggcgcagacactcttcaccaggtcgccggccttgatgccgcgcttcaccgcctcgggaccgcagactgccaggaaggtgatcttctccccattggcagaagccagcactgccacaacatccggggccttgtcccgcaggaaatcgcccatctgccgcagggcgttcgcatccatgccgttacggatagcggtcaggaccttcaggccgcccacgttcttggcggcggtcaggaattgccgggcctcgcccagggacgcctcggacttgaacttctccagctcatggcgcagctccttcatctccgctgcctgctgctccgccttggcggccagctcaccaggtgttgtcttcagcacttgagcggcgtggaacagcagctcctgattccggttcatggtgtccaggctcagtcggcccaccgtggcctcgatccggcggacgcccgaggcgacggagccctcggacttgatgcggaagggaccggccttggcggtgttgtccagatgggtgccgccgcagaactccatggagaagtcgcccatctccaccacgcggacgatatcgccgtacttctcaccgaacatggccacggcgcccttctttttggcctcctcgatgggcagcacctccgtcgctacggggtagccctccaggatggcgtcgttcaccagcttgtcgatctgagccagctgctccggggtgatagcctcaaagtgcgtaaagtcaaagcgcagccggtccggctccaccagggagcccgcctgatgcacatggtcgcccaggaccttcttcagggcagcgtccagcagatgcgtggcgctgtgagcccgcatgatggccttccggcgctccatgtcgatggatgcggtgacggtctcccccacgctgagggtgccggagaccaccttgccggagtgcatgaacttgccgcccttgttcttctgaacatccgtcacctggaaggtgccgttgggtccctgaatggtgccgtggtctcccacctggccgcccatctcggcatagaacggcgtctggtccagcaccaggatgccctccacgccctgagccagctcgtcccgcagttccccgtcggccaccagggccaggactctgccctgctcgctggagcgatcatagcctacgaactccgtggcgggcatgtccttgccgaactcgatgcctgcccagcccaggtcgcccagggcctcccgggccttgcgggcgcggaccttctgctcttccatcagagccttgaagccctcctggtccacggtcatgccggcctcctccgccatctccacggtcaggtcgatggggaagccgtaggtgtcgtacagcttgaaggcgtcagcgccggagaacacggtctccccctgggccttgtgggcggagagcatatcgtcatagatcttcatgccggcgtccagggtcttggcgaagttctcctcctccgtgcggatgaccttggtgatataggcttgccgctcccgcagctcgggatagtggccctcgttctcatggaccacggtgtcgcacacctcatataagaagggatggttcactcccagcagcttgccgtgccgggcggcccggcgcagcaggcggcgcagcacatagccccggccctcgttgctgggcagaacaccgtcacagatcatgaaggtggcggagcggatatggtcggtgatgacccgcagggagacgtcgatcttgtcgctctgctcgtacttggcgccggtgatctcgctgaccttgttggtgatgttcatgacggtgtccacgtcgaacagactggccacgttctggctgacgcaggccaaacgctccaggcccatgccagtgtcgatgttcttctgcttcagctcggtgtagtggccctctccgtcgttgtcgaactgggagaacaccacgttccagacctcgatataccggtcgcagtcgcagcccacggtgcagccgggctttccgcagccccactcagggccccggtcatagtagatctcggagcaggggccgcaggggccggagccgtgctcccagaagttgtcctccttgccgaacttgaagatccgatcctcggggatgccgatttcgtcccgccagatggcgaaggcctcatcgtcggcgggggtggtctcgttgccggcgaacacggagggatacagccggtccggctccagacccacccattcgggagaggtcaggaactcccaggcccagtggatcgcgtcccgcttgaagtagtctccgaaggagaagttgcccagcatctcgaagtaggtgccgtggcgggcggtcttgccgatgttctcgatgtcgccggtgcggatgcacttctggcaggtgcagacccggtggcgggggggctcctcctccccggtgaaccagggcttcatgggcgccatgccggagttgatcagcagcaggctggcgtcgttctggggaatcagggaaaagctgggcagccgcaggtgttcttttgtctcaaagaatttgagaaacatctcccgtagctcgttcagtccgtatgtgggatgtgccataaatgttcttcctcctaaaaatatctttttattctcaataatatatgataaataaaagcaataccgcctgttatttccagtcgccggcatggtgggatccgtcagctccgccgcggccagcagctgccgggccgccatgccgatcttccggggcagatccggcagttccctgtccagccgtacctgcagctccacctgtcccttgaccacgccccagatgttgttctccagatgccggggccagtaagccaaggagatgtctcccgggttcggatgtccgaacgccgcgacaatcaaccggtgcgcccgaaagaaagcccgataagaccgggcggttcccttccagaagggaaccgccgtcagctccggcggcagttcctcccagcagggagtgccctcccatcgatcccacagagccagcagtgccgtccccagctccggagccgtcagcggcggggacagggtctttaccgctgcaagaatgtgcgaaggcccgctccggctgcggatcaccggaaacaaaaggaatctcccctctgaatcggaaaaaatctggatgccacccaggcgggacgggtgcggagattgggctcgctgaaagaacaccagtatatcccctcttttctaaagcagaaaaaccgcccctgacgcacgtcaggggcggaagaacttccacggtaccaccctgatctgtcccatggggacatctcatgtcatccgctaacggggatgagccgtcccgctcgccgcaggccgctccaaagtggctgctccgcggcgtgggcaaggggctcgcaccgtctcccctctcgcttggccggtctcgcgaagctggctttgtcatagcttttcgctgttttcagacacaattattataaacgtttctgcccggttgtcaacgggaaaatcacaggttttttcccttgcctccggaaatccccgggaccttctttcctgtcagaatgcagacgccgtccgccacgcacttgccacagccgatgcagctggtaggtccgctcttccggctgtacgccgcccaacagtaaaacgcagtgcccgccagaatgatccccgtcgccagaatctcatgccacgccatgttgcagcccccctttttgtttttagtctaccacacaaaggggcacttgtctgtggcagctgcaacagccgcaggcccagcagcggcagcagctccgccgcaggagccggaagttccggcaggggaaattcctggggctccaccacgccgccgcccggccgaggcagctgccgctggacgcagaggaccggttccgccaggctggacagggtgagaccgtccctggaggacaggccataggtgaccaccgtctccgccgtgatgcgctccagcggcgcggtacagtcccccggcaccagcagcacccggcacagggcggccgtatcccccagctccccgcacccccggcgggtcaggaccagcagtggccaatactgttccgccagcgcctccgcccgctccgcccccagaacgccgggcggcagcagctttctccacgccgggggacagcagaagataactccctccatcaaaacacctcccggctagtgtctgctggaggttggattccatgcaaaaaatttgctcgtcattttgcacctgccgtgctatactggaacgtaagatactggaaacggggtgatctccttgcatttctgggcccatctgcggaccataaaccgccaccgggcactggtgcggaagtactgcttccgcctggggctgtactggcagggcctgacccatgacctgtccaagtacgcccctgtggagttctttgccggggtgaaatacttccagggggatcacagcccaaacgacgcccagcggaaggaacatggatacagcgcctcctggctccaccacaagggccgcaaccgccaccactttgagtattggacggattacagccccaccggcgaggggatcgtaggtgtggagatgccgagaaaatatgtggcggagatgttctgcgaccgtctggccgccagcaaggtctaccggggaaaggatttcaatcccggtgacccttaccagttctatctccggggcaaggaccggcggctgctgatccacccggccactgcagcgcttttggagaccatgcttttaaagctccgggatgagggcgaggacgcggcctttgcatatatccggcaggagatcctgggaaagtcccaggatgccccaccgccggacccccggcgcttttgacaggtgcacagattgtccccctccactgatgccgagaagagccgtatgccggcgagcaaacattgaccatgtttgctcgccggcatgagactgggcagcgatttacttgatatgggcgccgatctccgtcagcagccgcagcaggggccgccacaggtccgggtggtgctccagcagaaaggtctggacctccggggccgtcaggccgtctccccacagcagcacatggctgccggaggcgaactcccccacggcggtgggcgccacggcggagaccgccacggcgatcttggcggcaatggccgccacgccgccggcatagacccccacggcgctgacccccagggccagataccccagggccgccacgccgaaagccgccaatcccccgccacgatgcccagggacagcattcccatggccagcacgccgaaggtgaacaggcccacccccacgatgccgatggccaccacgccgatggcgcagttgccgatggcgatgatgcccttggccgtgttatccatggacagtttcccgttccggacgaagccgaaccggatagacaccaggggcaggccgaagatccgggtcttgctgtcgtagcggtagaccctgcccttcacataattggtcagctcgtccacctttttttccagccggtctgcctgcttggaagagatttccccgcttccgccgcatggattgtccggctcctccatccagtccttcaccagatagtccacggacacgccgaacagctctgacaaggagatcaacttcacaagttccggcatggcagtgccgccctcccacttgctgacagactgccgggtgacccccaggcggtctgccagctgctcctggctcatgccggacttccgccgcagccccgtcaatttctcggaaaatgtcatcggagaacactcgctttctcatttggatgcccttatgataagccacccgccgcgcacctggcaagaacgcggcgggtggaactttgtcaactccaggttgcagcccttgaggcccaggggattccagatttttgccaggctccgggtgctatggcgggagttcctgctgcgacgggcgatgaggcagggtgttttaccagatccccagcaggtgctggaccagcaggctgacgccggcaatggccacccagcagcagaagcccatgaagatgggcttgccgccggtcttcaccagcttcacgatgtcggtgttcagaccgatggctgccatggccatgacgatgaaaaacttgctggcgtttttcaggaagctcaccgcagccgcagggatgggcagaaccgtggtgatgatggaagccagcaggaacagcagcacaaaccaggggaagattttcttgatgtccacctgggcgccgccctgctttccctcccggcgggtcctcagcagggccagcaccagcgtgatggggataatggccaaggtccgggtcatcttcacgatggcggcggtgtccagggtattggcgccgggatgcattccatcccaggcggcggccgccgcagtgacggaggaggtgtcgttcaccgcggtgccggcaaagaggccgaagccctcgttggagaggcccagcacacctcccagagtggggaagatcagagccgcgatgacgttgaacaggaagatcacagagatggcctgggcgatctcctcgtcatccgcgccgatgaccggggcagtggcggcgatggcgctgccgccgcagatagaggagcccacgccgatgagagtggagatgttgctgtccatgtgcagggccttatagagggcgaaggccacgatcaggctggtggcgatggtggagacgatgatgggcagtgactgtccccccacctgtaacacgctggagagattcatgccgaagcccagcagcaccaccgccagctgcaaaaccttcttggaggtgtaggtgatgccgcttttggcacttttctgatccttccagaacagggcgatcaccatgccgatgaggatggcgaacaccgggccgcccaccacctcgaaccgctggcccagcagccaggcaggcacggcgattaccagacagatcaggatacccagcgcgttttttttgacaaattccataattcgtttcctttctctcttgacaatcggagttgtatcatatcatgccgttcaggatttgtcaaaaaaatccggggcggcctctggccgccccgatgatgcaatgccaggctcagtggagggggatctccgtctctccccacagcagatagtccgcttgagacagatccacaggccgggcgaagaagccgctctgctccatccagccgctgccgcccttgctgaagctgctggcaacctccacctgcgtcccatctttcaaaaccagcagcagttctgtgtcggggatagctatatctgagaattccactacctctccgctgtcagccgtcacaagcgccacggcgtctctgccgttttctgccgccgcggcctggacggcgttctcatcgtagtgatagctccactggagccccagaggagagaccttcagacgatccatggtcaaggtgccgcagggcgcctgtgccgtgacaccggcgacatccaccgccagcaggctatcttccgccagaccaccggagagcacgaagtcaaaatcgccggagaagatctccgtataggccttcccatccgtctgcttccacagccctggtatgtggaggacctttccctccaggtctccgtccgccagaatggagagtaccactgtcagcgtgttgtccgcaggatccgggtcctccagccaagtgaactccgtggaataagagatcgccgggtccccgccgtccggctcccgcagctcaagccactcgccgttcaaaatatcatcgccgaagagctggtaggtttcattttcaccgtccaagggtggcaggaccgtgccctctggggcctgaatctccagcatcaggtagaataccccatccatgccgaaggccgccataggtgtcatcatggctccgcctgcggagaccgcacccgacaggccgccgctgagggtgtccaccaccgcctgctcccccgggtccagtctgccgaaaaagctgtcccatagcgacgcagtaacagccgccgccgtgcccaccaacagcactgctgccagtaccgccgccatcccccgtttcatccacaagctccggtgctggaccggcggtccggcctgctccgccatcagggcgtccgtcagggcggacctccccgcttccgtgaactgtacctggtccaactcactctgataagcattcctatccataagcgcctcccagcatgttccgcaattttgccttgccccggtagagatacgtgctgacctgactggccgtgcagcccatcaacgtcccgatctccgccggctcgtatccctcgtaataccgcaggtacaccgcctggcggtatcgctccggcagggcctgcaccgccgccagcacaggcctctcccccggctccggcagatggaccgccgcgtgggccgccgcctccaacggcaggcgccgccggacccaggcggatttcttccagtccttgcagcagttgacggccacccggaccacccaggcccgctccagccgctcctccgcaaagcggcggggactggtcagcagcttcaaaagcaccgtctgacagatgtcctgggcgtcgtggacgctgcccgtccaggtccaggcgatccgcagcacggtgtccgaccaccgctctaccagttcctccgcttccgggcgggtatatgtgatttgttccgtacaatcaactcctttgccggcgccgttctgctgataaaacgaatgatgaggctgccatctgacagggacatacaaaaagcccgccgggaatatcccggcgggctgaccgaatgtccgcttactgctcttccagcacggccttgtgatagaccttcttgccctttttgatgaccgcgccctcgccgcagcagtccttgcagctgaacctggcctcaatatcggccaccttctggccgcagaccgtgacgccgccctgctgcaccagccgccgggcctcgcccttggaggcagccaggccgcactttaccagcagggtcagaatgtcgatctctccctcggcggtgaaatcctcccggcagagcttggtgcagggcatgttggcgctgtccccgccgccgccgaacagggcgcgggcggcctcctgggccttggcggcctcttcctcgccgtgaaccagcttggtcagctcgaaggccaggatctccttagcggtgttcagctgactgccctgccaggtatccatctcgtcgatctgctccagcggcaggaaggtcagcatccggatgcacttgagcacatcggcatctcccacgttccgccagtactggtagaagtcgtagggagaggtcttgttggggtccagccacacggcgccgctggcggtcttgcccatcttcttgccctcggagttcatcagcagcgtgatggtcatggcataggcgtccttgcccagcttgcgccggatcagctccgtgccgcccagcatattgctccactggtcgtcgccgccgaactgcatgttgcagcccaccgtctggaacatgtggtagaaatcataggactgcataatcatatagttaaattccaggaagctcaggcccttttccatccgctgcttgtagcactcggcccgcagcatgttgttgacggagaagcaggcgcccacctcccgcagcagctcgatatagttcagcttcagcagccagtcggcgttgttcagcatcagggccttgccctcgccgaactcgataaaccgctccatctgcttcttgaagcagtcgcagttgtgctggatggtctccggcgtcatcatggaacgcatgtccgtccggccggaggggtcgccgatatagccggtgccgccgccgatcagggcgatagggcggttgcccgccatctgcagccgcttcatcaggcacagggccatgaagtggcccacgtgcaggctgtccgccgtggggtcaaagccgatatagaacgtggccttgccgttgttcaccagctcccggatctcctcctcgtccgtcacctgggcgatgagcccccgggccttcagttcctcgtagatctgcatgatttgtctctccttttgtccgtttgtgaaatctgggacaggtatcaaaaacgccctctgtcccccaggggacagagggcgagaagttctcgcggtaccacctctgttcgcgccgccctcgcgggcagacgcctcaggccgtgcgaacacacggcggcgctgtaacgggcgctcccggagcacgcctactgggccgaaggccgtttgggtgccagctccgcggtgtattcgccgggccctgcccgcctctttccaccagaccagaggctctcttgggggcggtcttcccgggtactgctccgcttcatcactgtaagaggtattctagccgattttttacagcttgtcaacgggtggacggcctttctttttgcggaagaaatcgtatacacccttctggcagtcgtcctcatccgcctgttccagcatctggcggagacggctctccgcctcctgaagcggggcgcaggcgcagggtgtccgccgcaggatctccaggacctcatacatctcgccgccgagccgcagatagaggtacttgtaccggatgttctcctccgctttctccttatagaactccgcttcccgcctgtatgcctccgccgtctccagatcgtccattctgacacctccttaaattttgtgtctatattctagtacgctttttacatagtaactcgttttgtacttaaaatcaacttatattctactgaaatggagtttactatgaaaaagccacgggacagtcatcttggatttcgcatggataaggagacacatgacaagctgttttatatcgcggaatatgaaggacgaacaggcagcgggcagattctttacctgatccgccgctgtatcacggagttcgagcaggtccacggcaaaatcaatctggaggaagaactccgggactgaaggagccccctcccggtccggcgcggttttctgcgccgggcttgattttcgcgcccgcggccgctatgataggatacagatatttttcagaagtgaggtgccctatgccccaggatcccagacagcgggacggctgccaattcaccgcacagaacatcacagcggcccaggagaagaatccctttgccaagatctccgacatcgtctatgaactgctggagaaggccatcttctcctccgccatcccgccggggagcaagctgaacatctccaagctggcggagcagatgggggtcagcacctccccggtgacccgggcggtggagcggctggaggaaaacggcctggtgaccgccgtccgcagcagcgacagcaaataccgcagctacttcgtctttgacctcagcagcgagtccctggaggacctgttcgtggcccggcgggccatcgaaggagaggcggccttcctctgcgcacagaagcggactctgattgacctgcccaggctccagaagctggcggaccagttccagtccgcctggcaggactttgcgaaggatctggataccgcccccaccgcctccgagcgggccaagatcgacctggagttccaccaccagctggtgctgaccacagagaacgagtatctcatcgacatgttcgaaaccctccagggcacccttcactacctgtctatccgctcctgcgagttcgttgccacggaacagaaaaaggacaatctgatcgtcatgggctcccagcacgtggctatctgctccgccatcggcctggggctgccggagctggctcgctccgccatggagcggcacatcgatttctgctgcagccgctgcctcatcaaccgcacctttcacgccgccggatcccgctgacggcggaacgaaagcgccccagggcaaagccctggggcgctttcgtttataggagtgtcgatttcagcaaagttatttctgggccgccagcttctcgtactgggcgtaccgggcggcgcactgctcctccgcctcggcgaagagctgctcggcgatctgagggaaggtgcgggtcaggccggagaaccggacctcgcccatcatgaactcccgcagcttgccgttgggggccttgctgtccagctggaaggggttcttcccctccgccgccagctcagggctgtaccggaacaggggccagtagccgcactccaccgccagcttctgctccgcctggctcaccttcatgctcttggcgatgccgtggttgatgcagggggcgtaagcgatgacgagggacgggcccttgtgggcctcggcctccttcagggccttcaccacgtgggcggggttggcgcccatggacacctgggccacatagacatggccgtagttcatggcaatcatgcccaggtccttcttgggggtctttttgccgctggcggcgaactgagccaccgcaccgatgggcgtggccttggaggcttggccgccggtattggcgtacagctcgttgtccaccaccaggatgttcacgtcgatgccggaggccagcacgtggtccaagccgccgtagccgatgtcataggcccagccgtcgccgccgtacatccacatggtctttttcaccagctggtcggcgttgtcccgcaggaaccgcacgtcggcgctggagtcggcggtctggttcagggcggcgatcagggcgtcggacacggcccgggtcttgtcgccgtcgtcgccgtcttgcagccagctctccagggcggccttcagggcagcgtcggaggtggtgtccagggcggccttggcgtgggtcttgacctggttgcgctgctggtccacggacaggcacatgcccagggagtattcggcgttgttctcgaagagggagttggacagggccgggccgtgaccggcggagtccttcaccatgggaatggagggcacggacaggaacatggcctgggcgcagccggtggcgttggcgatgtacatccgctcgccgaacagttgggtcatcaacttcatgtagggggtctcgccgcagccggcgcaagcgccggaaaactccatcagcggccgctggaactggctgccccggacggtgaacttgtccagaggattggccttctcggagagggacaggcagtgattccagttgtcctgctccggcatctgggactccagcggcttcatcaccagggccttctccctggcggggcacacgtcggcgcagctgccgcagccctggcagtccaggggatccacctggatgcggaaggtataattctccatccccctgccgttggccttgtgggtgatgcagccggccggggcctgctccgcctcctccttggtaaacaggaagggccggatggcggcgtgggggcacaccagagagcactggttgcagccgatgcagttgtccggcagccactggggcacatccacggcgatgccgcgcttttcgtacttggaggtctccacctccgtcacgccgtcggcaaagctgaggaacttgctgacagggatcttgtcgccggcctgggcgttaacggggatcagcacgtcccggacgtagtccggcacacctgcggtctcagtctgctccaggggctcgtcgggcaggtccttccagctgtcgggcactcggatctcctccacggactggaggccccggtccacagcggcgtagttcatgttcaggaccttgtcgcccttcttgaagtagctgtgggtgatggcgtccttcatgtactggacggcctcatccaccggcagcacgccggagagcttgaagaacgccgcctggaggaccgtgttggtccggttgcccagacccagctcctgggcgatggacacggcgtcgatggtatagaacttcacatggttccgggccagcgtccgcttcacgtggttgggcagattccgctccagctcctcccccttccacagggtgttcagcaggaaggtgccgccgggcttcacctcgtggacgatgtcataggagtggatgtaactctgcttgtggcaggccacgaagtccgcctgggtgacgtagtaggcagagcggatggactccttaccgaagcgcaggtggcttttggtgacgccgccggacttcttggagtcatattcaaaatacgcctggacgtactggggcgtgttgtcgccgatgatcttgatggagttcttgttggcgcccacggtgccgtcggagcccaggccccagaacttgcactcgatggtggagccgccggcggtgctgatgtgttcccccacgtccagagagcggcgggtcacatcgtccacgatgcccacggtgaagtggtttttctgctcgccggccatgttgtcgtacacagccttcatctgggcgggggtggtgtccttggagctgaggccgtaccggccggccagcaccttgatcccgctgcgcccggcttccgccagggcggtgcacacatcctcatacaggggctcgccgatggcgccgggctccttggtccggtccaggacggagacggtctggacggtatccggcagcttggccaggaagtgggacacggagaaggggcggtacagatggacctggattatgcccaccttttcgccctgggcgttcaggtagtcgatgacctcccccagggtgccgcagacgctgcccatggcgatgaccacccggtccgcgtccggcgagccgtagtagttgaacagctggtagtcccgccccgtcaggtcgctgacggccttcatgtattcctccacgatggcgggcaggcggtcataggcgccgttgcaggcctcccggtgctggaagaaggtgtccgggttctggacggtgttgcggaccgtgggatgctcgctgttcagggcccgggccttgaagcggcggacggcgtcccagtccaccaggcggctcatgtcgtcgtagtccagcacctcgatcttctggatctcatgggaggtgcggaagccctcaaagaagtgctggaaggggatgctgcccttgatggcggcgagatgggctacggcgcccaggtccatgcactcctgcacgctggaggaggccagctgggcgaagcccgtctggcggcagcccatgacgtcagagtggtcgccgaagatggacaggccgtgggtggacaccgtccgggcggagacatgcatgacaccgggcagcatggagcccgcgatccggtacatgggcgggatcatcagcagcaggccctgggaggcggtataggtggtggccagggatccggtctccagcgcgccgtgcatggcgccgcaggcgccggactcggcctggagctccatcagcttcacaggctggccgaagatattcttcatgccggcggcggcccactcatccacgtggtctgccatggggctggagggcgtgatggggtagatcgtcgccacttccgtgaacgcgtaggagatataggcggctgcctcgttgccgtccatggtcttgaatttcttgaggctcatgcagtctcgctccttttttccatcctctcggggaggacagcgtgatttcctttcctactttaccgcagggggatgcctcctgtccaaatccatggaatttatgaaaaatcccgcggattttccacggatgcggacggcaatctccccagttttcccaggagtttttgtgcccggccgcgcttttgcgtccaggccgggcatgtgcctgccgctgttttccggctttttccggcatggttcggcccggcgcgggacaagctagggcggaggtgatctaaatgcatgatgacagccgcaaggtagagctcccccggcggagaaagcaggagaagcccatccccagcgtctatccggtgctggacaccgatctggcccgggacaacgtggaaaacgacattccggcggcagacctggaggacctgtgaggactccggacttcttccccacagctgggaggtgaagcgaatggcaagcatttccgtctccctggaccggaacgcggaccggcatgacgtgaagctgctgaagcgggagctggacaccctgccgggcgtcacctccgtcagtgtcagcagcggcggacagctggcggtggactacgacgccacaggcgtccggcaggcggacattctggaaaagatccaggcgctgggctaccacgtccggcaggaacacgcataacaaaaccgggaaccggccaaaaagccggctcccggtttgtttatgttccgttggcggactcccggggcctggaagaaactcctcccccgccgcctccatagccagactccccgcggagagctccgtgaggcggggaacgaactgttccgccccgcccgccgggaacgccgcccgcaggcggatgtccgcgccgtacgccgtgtcccgcaccacgccgccgcaggcggtgatctccagcttcacccgctcgaagaggggatatgtgcagggcacgtcccacagcgtccacaggctcatggtgctgatgcccacggcgtccagggcttccttggctcccttggtataggcccgggtcagtcccccggcccccagcagcacgccgccgaagtacctcgtcaccacgcagcatacgttggtgacgctctcccgctggaacacgttcagcatgggctggcccgccgtgccctggggctccccgtcgtcggagtagcggaccacgccgccctcctgcagcagatagcaccagcagttgtggcgggcgtcgtagtagcgcttcttcatctcctcgatgcgctcccgggcctctgcctcggtctccacccgccagatgtggctgatgaagcgggatcgcttctccgtgaacgcgctctccccgttttcaaagggcacccgataggtggtcatggccgtcctccctgtctgctccgcgctcatttccacacgtcccgccggtccgtccggcccgccagatagtccatggacacgccgaagtggtccgccagggcgcacagattatggaaactaggcaaattatttccagactcaaatttctggtaatgccgttctccaattccaatggccgtggcaacctgggcctgggtttctccgcgctcttttcggagcgatcgcaatttttcctgaaattccatgcgtcccccttgacacgccaaattttaggtattatactaaacttagaaacacgccattttttatgttattcgaggtgatttttaggatgacagattttatgaaatggctctatccccggtatatccgcccttatgtggaggcggcgccccaggaagaatatgagatgtggctgtccctgatggagagcgacttggaatatcaattccgggaggaattcgacaagaccctggaattcaccgccatccacgccttcctgctgggcctgcgcaccggggcgggcctgggggcgctcattccacaaggaacggcgccatctgccccaggaccttcggcgtgcacaccgccgtgaccgcgatggtctccccgtactccacgttctccaccttggcctcccggtacagctggtccagcaggccgcccttgtcgtaggggatgtgcagcacacagcggcggctgccgctgtccaggcgttccccgatcatctccaacagcttgtccacaccctcgccggtcttggcggagagggagcagatgtccgccccgtggggcatgatctctccggcgggcagccggtcggacttgttgaacacgtcgatccggggcagctctccggcccccagctcccggatcaggttctccaccaccgccgcctgctgctgccactccgggttggacacgtcgatgacgtggagcagcagatctgcgtactccaactcctccagcgtggccttgaatgcctccaccagctggtggggcagcttgcggatgaaccccaccgtgtcggagatcaccacgtccagcgtgtcgctgaccgtgagaaggcggctggtggtgtccagcgtgtcgaacagccggttgttggcggggatgcccgccccggtcaggtggttcagcagcgtggacttgcccgcgttggtatagcccacaatggccaccaccgggatttcgttcttctgccgccgctgccgctgggtggagcgcacccggcggacctcctccaggtcctcccggagcttgtcgatcttccggcggatgtggcggcggtccgtctccagctgggtttcgccggggcccttggagccgatgggccccttgccgctggtgcccgcctgtcgctccagatgggtccacatgccggtcagccggggcagcagatactggtactgggccagctccacctggagccgcccttccttggtcttggcccgctgggcgaagatgtccaggatcaatccgcaccggtccagcacctgaacgcccagcagctccgtcagcacccgcatctgggagggggacagatcgttgtcgaagatcaccatggtggcgccggtgttctcgcagtagagctgcacctccgccaccttgccctccccgatgaaggtccgggggtccggggacggccggttctgcagcacaatccccacggtctcgcctccggcggtctccaccagggcggagagctcctccatggtgtcctcgtcggcgttttcctcttttttcagcaccggggagttcaaccccaccagcaccactttgtctcgtacttcctgtgtctctgccatgcaaactccttatttttgataggcctccacgacttggcccacatagatccggtgccagccgccctgccccggcgtgtagaagggcaggatctccccctcccccagcacgcaggcagggtccatgtcctgggcgtacagcttccggcacaccaggacccactccgcctcgtcaaagaagggcgcgtccccggccccccagcggaccgtcaggccgcacgctttcaccttgtccacgtcccggccgctcttgctgccgcagagggcggtcactttttttgcctcctccggcaggatggagacggtgaaataatcgtgggactccataaattgataggtatatcgctcgggccgcacgtagactgtgcagaccggcaggttccacagccggcccaactggcaccagccgatggtcatggtgttcaggccggtcttgtctccggcagtcagcagcgggggctgccgtccgaaaacatgcaggatctccggcgtcaaacgctccaactccacaggatgcagcttcatgcaaacgctccttccgcttcattgataccatacagtatatgcgcttttgccggaaaagtaaatgaaaaaagggcctgcccaaccggcagaccctttttgtgacgtgtcagacttacttgtccagaccgaacttcttgttgaacttggccacgcgtccgccggtatccaccagcttctgcttgcccgtgaagaaggggtgacacttcgagcagacttccaccttgatatccttcttggtagaacctgtctcaatcacattaccgcaggcgcaagtaatcgtagtctgctgataattgggatggattccttccttcattgctctcgttcacctctttctgatccagactacctcgccggagctttcaccccataaaggcgtttatcagtgtatcacacggacgtcaagattgcaagaccttttttcatttttccggagattttttcaggaggggcgaaactgctccacccactccggcgtacagtccgcaaaccagtcctggtgatccgggtcctccgggtcgtagagccggtccgtcagggcctggaaggcgctccactgctcctcggtcaaaacatggacggagatgccgtcctcttcctgccaccgctccaggatctccgcctcctgctcccggttccggagccgctggtccgccatggcctcccggccgcagcggtccaccgcctcccgcaggtccggggagagggagtcgtacagatcactgttcatggtgaggatggcgggctcataaaatgccgggaagatggtcacgtccgtctggaccgtctggtagcccgccgcgtccgcctccgccagggtgctctcctggccgtcatagtatcccgcagacaaaggcgtcatcacatctaaaaaactggaggggtagagttccgctccccagcaatccacatacgccacggacacttccagcattcccgccgtgcggatcttgagcccttccagatcttccggggcagtcaccgcacggccttcagaagtcgtcggataccggaagcccagctccccgtatgccaagccccggagccccagctccgccaggacaccgttcagtgcctctccgccggtgctgtccaggacctccgccgccgtttcggcgtccgggaacagaaagggcatggtcacggagaaaaacggtctgcccaactcttcttcgtcgccgtaggagccatatacgaaactgctgtccagatagaggtccacgatcccggccgcagcctgctccagggaggtaaccctatcgaggggcatcggctgaacctccaccgccacggcgccttccgtggcgtcggacagtgcctcggcaaaagattccgccgcgtcccagcaggtggagccctccggctggcccaccaccagggtccaggttgtctcaacattcttcggaaccggcggctcctctgaaacctcctccggcactccgccggtgcagccggtgagggccaggaccgccagaccggcagcggtcagcttggtaagacggcgcttcatttcaggtccctccttcttgttccagcgcccgccccaggtccgccagataccgagcctgctggcggcggaggtagcccttggcaaagaagcgcatccagggcttttttacggtgatggtctcggtgaaggtgacctgggtgccgccgccctccggccggaattccccggcccaccggcccgccagattggcattgtccaggtcaaaggcccagcgggacagggggcggcgttccgtgacggtgaagcgggtgggaaagccgcttctgtcgtactccgtaaaggcgtcctcaccgacgtggtccagacggctcagatcgctgcgccactgccagcagtccagatccgtcaccaccgcccacacccgctccggcggatacggcaccagggccgtggctatactgacgatttcccttcccattggccttcctcctcaaatctccatggtctcgcctgcagccaggaaatacagggcccggcggaccaccttcttttccagcacccgctccagggcccggctgtatgcctccagctgggggcggtagtgctccgcccgctgccggacctccaatgccgagaacacacggtccgttttgaagtccaccacggtcaggccgtctgccgtctcgaagcaacagtccaccacgccctggaggaggatttcctcccccgccgccgcggcgggatcgtagtcccgggcatccatcagcagggtgaagcgatactcccgcaggacgcttcggcttttgcggatctcctccgccaggggggagcggagaaaccgctccaaaggcgcggtctccacggccgcggcctgctggtccgtcagcaggctccgctgccgcagcgcctcgatctggcccgccacgtcaacgtttgagaagtccaggtattgcagcaccaggtgggtggcagtgccccgctctgccggggtcaggccctgccgctcccgccggaaattcggctggctcaggggccggaggtacggggtatgggcggcatactccgcgatctcctggtccgcagggcggcccttcagctgggtggccgtcaccttggcgggcagggccgtctcccgctggtaggggtagatgaaagacagcagctccgggtcaaagagggcggtctcccctgtctcctccgccgtcgcctggggccgagcgggccgttcccggtagtcctcactgtcatgtaaaaacacttgccaggatctgtcctctccaatatatagctggtcaatctctgtctccgccatagcccgcaggggtgcggcctccggccggcacagcaggggcagcaggacccagtcccccagggtgcggccctctgccaccgtctccggcagcacgggacaagcagccacagcggccagcttctggagccgcccggtggcgttgtacagggcgtccaccaggatcagcttctccttgggccgggtcatggccacgtagaggatgcgctgctcctccgctaggttctcccgccgcagcttttcctgaatggccagccgggccagggtgggatactggattttccgctccaggtcgatgcgcttgggccccaggcccatgtccgggtgcaccagcaccggcgtgtcgaagtcctgccgggagaacgcgtggtccagatctgccaggatgacgatggggaactccaggcccttggacttgtggatgctcatgagccgcacgccggcagcctccgccgggccccgggtggcgggagcctggtcctgctccagcagccgccgcagctgagtgacgaaggcgaagaggccccggtatccattgctctcaaacttctccgcgtgctggctcagggcgatgagattctcccgccgggccgcaccatcatccatggcgccgaagacccccagcacattcagtcggttgtagatgtgccagaccaggcggtggacactcatgtcccggcccgcctgccgcagatccgagaggattgccaggaagtctttgcagtcctctcccccatcggcagtcacagcgtcgtagtagtccccggtgggggcggcggagcgaacctccgccagccggtccgccgtgaagccgaacaggggtgaccggaggacggagatcagaggcacgtcctgccgggggttgtccacgatctccagcagggacagcatgacggagatctccatggtgtggaagaagtccccgctctcctggaaagaacaggggatgtcccgctccgccagggcggcggcgaaggcggcagaccggctgccgggggaacgcatcaggatcacgatatcctccggccggcaggggcgcagggtgccgtcgctctccgtgacgggatagccctcatccagcagcttccggatgcgcgccgccacgaaccgggcctcggcggtgaccttctttaccggcttgtcattctcccccgccttctggtgggcagagatgagatggaactctgtctggcaatccatccgctccgggtaatacgccgccccgaagtggagggcctcgtcctcgccgtagtccatctcccccatctccacagacaaaatgttggagaagatgaagttggtgctctccaaaatctcccgccgggagcggaagttgcgggacagcaggatcttccgctcctctccgtcagccgcctcctgccaggacttgaaccggttgtattttcccaggaaaatggtggggtccgccaggcggaagcggtagatgctctgcttcacgtcccccacagtgaagatgttctgcccgtttttggacaccgcccggaagatggcgttttggatctcgttggtgtcctggtactcgtccaccaggatctcccggtatcgggccgccacctgctcccccagctctgtgggggcaccgccggaacccaccagcaggcccagggccaagtgctcctggtcggagaagtcggcagcgttcagccgcagcttctcctgccggtaccgctccgcaaagtcctccgtcagctccagcagggccaccatggccggggccacggcagtcaggtcctccatagcctcctcctcagagacagacaacaggcccgccagcttcttctcctccgccttgcaccgctcccacacctgtttcagcgcggcaatgcccggctcgtccttccgtcctttgggggtggaaagccgggggaaggcgacggccgcttccgtctgccgggccgcctcccaggtctggacctgggccagggcgtcaaaggccacagacacctggagaaacttctccccgtacccccggtacagcgcctcgtccccctcggtccgggcggaggcggaccggagcagggccccccaatgggcccccttccggcggatggcggccagcagctcggcggcgtagggggtgtcatcaaagccgccctcccagccgccccagacggtccggttctccgccagccacccggccgggtccgcgtggctctggaccttgtcgtacagctccagcaccagggcggccagacggctgtcgtcccgtccggcccccagcgtgtccgccagcaggccacggccctcgtccagctggtcatagaagtcctccagcgtccgggagagcacccgctggcggatcagctgggcctcgttatcgtccagcacccggaagtctggggtcagggcccggctgtccccctcccgggccaggaggtgggtgttctcccgcagcagcgacgtgcagaaggcgtccacggtcttgatgtccgcctgatacacccgcagcagctgccgccggagctgctggtcccccggcgtctggcccagccgcttggacagctcggaggcgatcttgctccgcagctccgccgcggcggccttggtgtaggtgatgatgaggaaatcatcgatattgcagcgttcctccgtcacatagcggaaaagccggtccaccagtacctttgtcttgccggagccggcggcggcggacaccagcaggctgccgccccggttttccaccaccgcctgctgctggggggtcagggtcaattttgccatgttactgtccgcctcctctctctgtctcctcttccacctggcgccagaactcctccggctttaccggcaggatgtagtgcaggtggtcgccgtcccgcccatcctggaagtggcaggcgtcggcccagtcgcagtatttgcagaagctgttgtcctcattgtggcagcaggggtccgcgtcgatgttgccgtcccggacctcccgggcgatctggtggagcagccgctccacatactgccccagccgcccaagctgatcggcggaggccagggcgccggacacgtccccctcccggtttacccgcaccggtaggaaccggggactttgcagagcctcgtgctccatggcctggagcacctccggttcagagagcagcaggcccgttcggcgcagctccttctcccgctggctctggagctgctccggcgtgatatttcgctcggcggagagaatctcatcccgggcagggagatacaacaccccggcgggctcaatgtccatgccaaaccgctgcttgccctcctttttcagggcgaacaggtacagcagcatctggatatccaggcccatccggacggcggccaggtcaaaggctttcttgccggacttgtagtccactacccggagatacagtctgttgtccttcacccagccgtccacccggtccaccttgccgccgattcgcagctccgcgtccggctcgctgaccgtcaccgccggcagttctccgcgctcgccgaaggacagctcgaaggccaggggcacgaagtcggagcagcgcatctcctcggcgatctggtccaccaccgcgtaagcggtgttccgcagccgggcgaagaggtaccggaaccgggcgttccggccctccagattttggagcacctccgccgcatactgctcaatatagcgccgcaccaaggcgtggaggtcctcctctcccactgcggcaaagccgccccggtccagcacgtcctttgtgacgtgctccagcaggtagtggaggaaggttccgatctggggggcgtcaaaggccgccgcccggcgggccttggccttcaggccgtactccataaagtaggcgaagtggcagctccgcagccgctccacccgggaggcggacatggagatccgctccccgtacagcgattgtaccgcgctcctggagaggctcccccgcttcagcgcagccgcccgctccatggccgccatggggggcgccaggacctcgtcatctgcgaaataccgccacaggatcccccctggggcggtccctgcggtctccaaggcagggatccttgctgtaaggcgataagccttatcagtcccttcgtgctcgatacgcagctccggaaacagcgttagcaggcggtccactacaaaggcaggccgcagctctgcaccggacacgtccgccgtgggatagctgaccaccagtccctcccggggctgaaccagagcggcgtagaggttctggagctcaatgcccatctgttccatgccgctgggcgccaggcggataccccgctgggccaattcctcccggtcatcgtcgttgagaatgccgccgctctgtcccacagcgggcagcacatggtcattggcccccagcagaaacaggtaggcatccgtgtgacggtcatttcgggtgatttccgtgacggacacctggtccagagacacggggatagtgcccacgctgtactgggaggccacctgccgcagcaggcggctgaattcatcggtccccataggctcgtcccccaggatctccacgaactggtccaggatggcgcagaggatctcccacagctgggcggtctcctccgcgtcctggaggcgccctgcctccgcctgggcccgcatctgttcctccagcgcgttctggagattcagatgctccaggaaactataaagggaatttactttctccccagctgtaacgccggctttcagcccttcatacagctccgcaagaggtgcgcgtacccggcggcgcagctcgttcacccggtccaggcgggcctggcggcgcttatcccaaggtgcgccataaccgtccggattgtcggtccagtccacatcccggagccacatcttcccgtggatctcccaggtgagaacgtagttttccagctcatcgcactcctccggcatcaggcccgccaggccggtcttcagccaacggaacatgtcctcgtactccaagccgttttccagagcggagaggacgccggtgataaggctccacacgggcttttccaacatactgctccggcggctcagataggcggggatgctgtaccgctcgaataccgtctcaatggtgccctcgtagtcggtcatgttccgggcggccacggtgatatcccggtagcggcacttccccgccgctaccaggcggcggatgtccgctgccgtctgctccacctcggaaaaagcggtgtccgcctcccggacccggatggcggagctgtctccttggtagggctccccctctccgaagaagtgatgctccaaatatcccagggcggagtcgtcggcgctggtgagcgtccggacctcccatgggcagcccgcctggtccgccagccgcgtcagctggtcccgggtgcggagagagacctgaaacatctcctccgcgctgtccggctcccccagcagcgtgacagtgacagaccgagcctgccgcaggatgctctccagcacctgccgctcctgggcgttgaagtacgtgaagccgtccacaaacacgtccttgccgaaagcgtagcgggaggactccagcgcctcgcagagcttggtcatccggtcccgggcatcaaggccggggcggtacagccgggactcataggcgccgtacagcaggctcaggtccagcagcttgtcccgggtggcgccctggatttcccgtgcctggctctccagcagctctggggacacgtcgtagcagcgcagctcgtcgaagaggtccagcagctgctgtaaaaacgacgccttctgagagggacggcgatacaccttcagcaagggggccacctctcccagggccttctgcagggtcaacagcttgccgccggcatccaatgtcacctgagcggcgccgccggtgatggtcagcacccggtcgcacaggcggcggaagctgaggacctccgcatggcggctggcagtgtctccgcaggcacggcacagatccacctccgcctggtgggaggcgtgctccggcaccagcaggatctgccggctggaatcccccagttctccgatccggcggagcacctgttccgattttcccgttttggcccggcccatcaggatcgtcagcatggcgggacctcctttgcgcaatttcaaaattcattgtagcatatcccgccgattcgtgctatcctgtttcttgaagattttccgaggaggactgacccatgcacattccccaaggccccacagccgccctggcgctggagctcttcgacgacgccctggccgctgccctccggccgtcgccggactatgatgtgagccggtggctgtacgtccccaaccactattcggaataccggtacatcctgggcacccggggccggaagcccctgatctgcatgggtatcaacccctccaccgccgcgccggacgctctggaccccaccctccagtccgcccagcggatcgcgctttccaacgggtacgacagctttttgatgttcaacgtctacgcccagcgggccacccggcccgacgatatggagcggtcctgcaacccggtgctccatgcggagaaccgaagggccttctggtatctcctctctctgtccccggcccccgccctgtgggccgcctgggggaacatcatcgagaagcgagggtatctgatggattgtatgcgggactttgccgccgacgccagcgccgccggggccgggtggttcaccgccggccccctgctgaaatccggccacccccaccaccccctgtatctcaagggggacacgaagctgctggccttcgacatcgacagatatctgcgggaccgggcaacctgaaccgctgcgaggcacaaagcaggccgccccccaatggggacggcctgctgtttttctgtgtcacagccactttttcttcttgaagtagatcaccagcgccgccacgatccccacgctcaccagaatcaccgccgggtatccgtacttccagtggagctccggcatccccacaaagttcatcccataccagcctaccagcagggtcaggggcaggaacaccgccgtcaccacggtgaagatcttcatcaggtcgttctgctggatggacagctgggactgataggcctcccgcagttgggccacggactcccgcagggactggaccgcgttcagataccgctccatccgattgcccaagtttgcaaaacggcgggtgttctgcttgcccagcaggctgttgtcgttctccgccagctcgtcaaagatggaatccagctgctcgtagtaccgcttcagccgcagcagctcctgccgccaagcgatgatccggtccagatacgcctcatgggcaccggtgagcacctctgtctccccatcgctgatgtccgcctccagccggtccagatgggccatatcccccctcagcagccggacgaagaagcggtggagcacctgctcgttggacagtgcctcttcctccggcaccagcagggccgcctgggcggcgtcctccgctgcgtcgtcctcacagaagacgaacaggtcctcccggtccagatacagcagcatctgggatgctgccgtccgctcgctgcgcacgtcgtaccagtcaaaggcgatcagatcgaagtcctcaaagccctcaaacgcttcgatctgcccctcgtggatgtagtccagcaccttggcgtccatatagggctccatctcccggatgcgggacatgggcagtacctttcgcatggcggtctctctcctctcggtctctcacaggttttccaggccggcgtccttgggcggcaggccgtcatagagcccggcgcacttccacagtgccgcgagaaaccagatgatgcccaccagcagggcaatcagggccatcagtgccaaagcgtccagcagcaggccgcccagcgttccggcaatctgtgccgccaacaggacaaaccaggcggtccgtgccgaagtgccgttcagatctgtcccataatgggtctccatctccaaaatggcctggatcacgctccaggaaatatacagggcgaccgccagagcagccagctccaggagcgtactcagccagtttgcgccggtcacgcccagcaagtctcccacccacaggatacctgtgtatatggccacagccacagcaaaggggcggagtttcccgaatcgaccgctctctcccaacaattcccctgctgcccgatagagtaagatataacccgcaaaggtcggcagcagattcagtgtatgtccgttgattgtcacataaaaattgataaagatcaagaagaacccccaaaagattcccttcactgcatttcctcctcccgcttcttttgtacatgcctttttccgaaatacagcaccagcacccccgccgcgatcttcacggcggcgtacagggccgggaacagcagcacacctgccgggaacacgtcaagcagattcactccgcccatctccgccatatcccagccgatcagacccgtgaatccgcccagcatcccccggtacgccagataaaacagcgccagctgcaccagatccaatacgccccaggcgatcagcacccatcccagcaggtaccacttccgcttgctaaaggccaaaaaacgctccacccagtccttccgttcctggggcggcggctgcttctcctccggcttcgtctgctccagctggaggcggagcagatagtctgttgtcacaccgaaaatatccgccagggccaccactttgtccgtctccggcatggtctcgtcccgttcccagcggctgacggcctgccggctcacctgcaggcgctcggccagcgcgtcctggctcatgccggctctctgccggagggattgcagcttctctccgaatgtcataggcattctcccttctcttggatgccttcagcttatcaggccgcccggttgcataccagcaaccaagcatggaagttccgcaatctcagattgccttcctctccaacataccacaacagggctccccgcgcaacggctccggcccatattgcaagaaaaaaccaaggcaccggacgtctccgcatccaagcgccccggcctatcgggcgggctccagcacaatgggcaggtccacgatctccagcccccggcgcatggcgtactccaccgtgtaccgggttccgccgggagacccgtcaaaggcggcgatcagcagcgcggcgtggtccaccatataccggtcccgccgctgcatacaggcgggggtgtagcaggcggacaccagggtctcaaagtcacaggcagccaccagccgctcataccgccgccgctggtccggcggccaggcatccgcctgggagggacatgggacggccgcctccaccgtcacgtccgggtgcgtctggcgcaggcggaggacgcactcgcagaaatacaggtcacagcccagggccatgccgcagagaaagtgacggaatccctcctgataggccgcctccaccgcgtctgcgatgcgggccttgagcgacacgcagcgcaggtcctcctcgttataccgccatggcagcttaccgggccggtgcccggtaaagcagcaggccgcctgccgcccccgcatggtctccgcctccctccttctggtctttgattcagtatagaacatccgttcttgtttgtaaagacccacgggaaatttgccgttttttcatttagggacttgcaatttcttccgcgctgtcatatactatggccagaaagcaactgaatactttgtcttcagggcggggtgaaattccccactggcggtacagtccgcgaccgcctgcgcgtatgcacaggcgctgactcggtgaaactccgggaccaacagttacagtctggatggaagaagatgagtgcggcgtggccgcgcgtttgttcgcgctcctgcgttgcgtggatcaccttggagaagccaaagcgtccagggtgttttcaagcaacgaaaaggagtgtatttttatgtccgaacccaatgccaacgccatcaagaacccctcccggcccgcaacaaacgtccgaaccatcacctccctggccatgctggcggccatcgcctatgtggtgatgctcctcagcaagatgctgccacaggtgtccggcttcctgcagatggacctgaaggacacggtcatctgcatcggcgccttcctcttcggacctctgtccgccgccgtcatctccatcgtggtggccgtggtggagatgttcaccgtcagcgacaccggccccatcggctgcatcatgaatgtgctggctacctgcgccttctgctgcaccgccgccttcgtctacaagaagttccacacccgcaagggcgccgtcatcggtctggccctgggcactgtttgcctcaccgtggtgatgctgctgtggaactatctcatcacgcccatctacatgggaatggatcgcgaggaaatcgtggtccccatgctgatcccggtgttcctgcccttcaacctggtgaagggcggcctgaacatggcgctgatcctgctgctctacaagccggtggtcaccgccctgcggaaggcccggctggtaccggagtcccatgcgcctgtcgagggcaagggcaagctgagcgccgggttcctcctgttctccctggccctgctggcaacctttgtggtgctggccctggtgctgatggggattctgtaaatctgaacaccacaggcgcgggggcggataccgtccccgcgccttttactgcggcccatatccgtccctccgcctccctgcgccggtatgtcaaaaccttcccatcccttctcccttttcaggaacgaacagatgtgctataatagaagtgagaaaggaggcggggccatggaccgcatcatcctgcactgcgatctgaacagcttttacgcctccgtggagctgcggagccgaccagacctgcagaacgtgcccgtggcggtctgcggagatcccacctcccgccacggcatcatcctggccaagaatgaaccggcgaaaaaattcggcgtccagacggcggaaaccatctggcaggccaagaaaaagtgcccggagctggtgctgctgccaccccaccacaaactgtaccggcaggtctccaaagaggtcaacaccatctacgagcagtacacggacctggtggagcccttcggcatcgatgagagctggctggacgtcacccataccctccacctcttcggcggtgatgccaaggccctggcagaccatctgcggcaacggatgaagcaggagatgggactgaccctctcagtgggggtctccttcaacaaggtgtttgccaagctgggcagcgactaccggaaacccgacgccaccactgtcgtctcccgggagaactggcagaggctggtctggcctctgccggtggggcgctgctgtacgtggggggcgccgcccggaagattttggcccagttcggcgtgaagaccatcggagagttggcggcctgcaagcgggatgccctggagaccctgatgggcaaaatgggcgtccagctccacgactatgccaacgggctggacaccgatccagtccgctcccggtacgagccggagatggtgaagtccgttggcaacggcactaccttcccgaaaaacctcaccaccgcagagcaggtgcggggcggcgtcgccgtgctggcggactccgtggccacccgactgcggcacagcgggctgtatgccggcggcgtccaggtgacggtgcgggatccccagttccatgaccgctcccgtcagatgcagctctccgcccccacccacctgatccgggagctgacggcggcggccatggacctgaccggccagctgtggaaacccccggctcccgtgcgggccctgactgttaccgccatccatctggttcggtcggaggacgcctatgaacaggtagacctgttcacagctggggcggcgcccaaaaaagaaaaacaggaaaagctggaggcggctatggaccgcctccgtggaaagttcgggaccgacgtcatctcctacggcgcggcccgtccagagaaagaggaggatcccctgccatgacaatagacgaggaaaaacagcagctccgggctacgatccggcgcctcagcgcccagctccccttccggtaccgggaagcagcggaccgggccatcgcccgccatctcctggctcttccagagtatcgcagtgccggagcggtgttctgcttcgtctccgccgggcgggagatcgacacccgtcccatcctggagcagactctggcagacggcaagatgctgtgcgtccctctgtgtgtggcggatggcatcatggagctgcgggccatccgcgacctgaaggagctcttccccggcgcctacggcattctggagcctccggcagacagccctgccctctccccggaccagatcgacctggcggtgatcccctgtgtcacctgcagccgggagggccgccgtctggggcggggcggcggctattacgaccgcttcctggcccactaccggggcgcggcggttctgctgtgccgggagcggctgctgcgccaggagatccccttcggcgtccacgactatcccatcccctgggtgctgacagaagccggactttttgaggacggcacgccatcccggctggaatgactgggaaaaggtccgcctcccacaaaatcgtcaaaatattcccactatctctacaacattttgtgggggtattacctcttgttcccttgacaggtccctggaactctgataagctggaaaaggcttatattttccggaagaccggatcacacgaaggaggacccctgcaatgatccaggacatcatggactttctctcccaggccgaccccgaggtgggggcatctattcagaaggaattcgaccgggagcagcacaacattgagctgatcgcctccgagaacatcgtcagcaaggccgtcctgctggccatgggcacttgtctcaccaataagtatgcggagggctatcctggaaagcggtattacggaggctgctatgccgtggacgtgacggaggagctggcgcggcagagggcctgtcagctgttcgactgtgcgcacgccaatgtccagccccactccggcgccaacgccaatctggcggcgttctttgccctgctgcagcccggtgacacagtgctcagtatgaatctggcccatggcggccatctgagccacggcagcccggtgaacatctccggcaaatatttccgcatcgttccctatggcgtgtctgacgacacagagaccatcgactacgagcaggtgatggccatcgccaaggagtgccgccccaagctgatcctggcaggggccagcgcctatccccgcaccctggactttgccaagttccgggagatcgccgacgcagtgggcgcccggctgatggtggacatggcccacattgcgggtctggtggccgccggtgttcatccctcccccatcccctacgccgatgtggtgaccaccaccacccacaagacattgcggggtccccggggcggcatgatcctgtgcaatgacgacgacctgtacaaaaagatcaactccgccgtgttccccggcacacagggcggtccgctggagcatatcatcgccgccaaggccgtgtgcttgggcgaggcgctgaagccggagttccgggcctatgggcggcaggtggctgccaacgccggggttctggcggaaaagctgatcgagcagggcttccggctggtctccggcggcacggacaaccatctgattctggtggacacccggcactttggcctcaccggcaaggagtatgagcaccggctggatgaggtaggcatcacggtgaacaagaacaccatccccaacgacccggagaagcccttcgtcaccagcggtatccgggtgggcactcccgccgtcactacccggggcttccgggagccggagatggcggagatcgcccggtggatgggcctcatggcaaaagaggactatgcggaccatgcggagcaggtccgtgcggaagtggcggagctgtgcaagcggttcccgctctatcaggactaaaacaacccccgcggaggcaaaggcacccccgcacaggggcatcaaccaaataccgttcatgagtagagcatgaggccaccgtaaatcacccggtggccttgctttgcatgatacaagttgacgcccttattagccctgataggcactacccccctcagtggtttcctggtgaacgctagcaccccccatgcgtgacaacctccaaaacaccagtcagatcaaagctatcaagacataaaatacccccacccaattcgggcaagtctcatcaacttgctcaaattgggtggggtattcatcacaaaatgctagggagccactgtgtcaattgtgggataaatgtgaccagcatcaatgccaccaatgagataatcagcgtggggatcattgtgcgaatagtcttggacaaactggtttctccgatttgattacagaccaacagacataatcctaccggaggtgtcaccaaaccgatacagaggttaaaactcatcatcacaccaaaagtcaaaggatcaatattaaaaaccggtaaaagcggagtcagaaggggcgtcatcatgataatggcagcactggcctccatcaacataccaataatcaagaaaagcagattcagcaacagcaaaatcacggccttactgctggtaatagaggtgaagaattccagcatttgctgaggcaatcccgatgtgaccaccacataactggatgcttttgacaagccaaccaacatcataatagtcgcagtagaaatagatgtctccacaaaaacttgaggaatgtccttccatgtcaggtctttgtaaatcaatccactgacaaagagtgcataggcaacggagaccgctgccgcttctgtcggcgtaaaaatgcctccaaaaatgcctcccaaaataataattggcatcagcaaggcccaaataccgttcttgaaagcccgcaggatctctatggggctgcttttccgataagacgggagatcatgctttcgaccgtaaataaggcagtaaactgcaatggcacacgctaagagaatgcccggcaaaaccgaaccaataaacagtgacgccacagagactgtgctgacacttgcataaacaataagggggatggatggaggaatgatcggacctaaaatagaagaaatagaagaaatcgccgtagcaaattcatccgggtatcccgattttttcattgcggggatcgtaatgccaccaatggcagaggccgtcgccacaccagaacctgagatagcaccgaacagcgtagaggacaaaacagttaccactcccaagctgcctttgatttgcccaatcaacgcatttgcaatgttgatcagtttctcggtaatacttcgggacattagactccctgccaaaataaaaaaaggaattgccagcaaagagctagaattcatgccagcaaagagtttttgtggcaacacgatcagcgccatatccgccatatggagcgctaccagagtaccgattcccaaggcaataaaaatgggaacaccaaggaaagataagaccagcaagaagatgatcaccacaactcccacattcattcttctttccctcctttacgaaagtccctgacttgcttgaaaatcacttcaactgaagtcaaaatcatcaggacggttccaatcggcagacacagataaggaatcgacataggaacgcctagtcccacagaaagattatttgctccagtctttaccaaatcaatagaatataccagtaaaaagcagaggaaaaccacacctatcaaagttgaaataactgtgctcagcattctccagcgcggcttcagcagatgaatcaatgcatcgatttgcagatggctatttcgtcgtataccaattgcagaagccagcatcacctgaaagataaataaataccgagccagttcctcgctccatgcggtagcatgtgcaaagacatagcgcaaaataacctgatagatcatgacaaccagcattactgctactgaaatgcatagcagcgctttttctattttttccacaatatctaaaaattttgaatatgccttcattttttcttttgcctcctgtcacagctgagacttagaacaaaaagcccgacagatgccgggcttttgtgtccatttcaagttgcggcaagggcctgctgccgccgacccagcggatacaaaccaatgcctgctacatgaaaactacgaattagccggatccattgccttgatgcggcccacccaatccgccaagttggggaagtttgtctctgcaaaggtatcaaagtaatctgcaaacgcttttgtatccacttcgatgacctcacagccctcatcgagaactttctgctccgcttcttggtctctctgcttctgaactgcgctgatttcctgaccagcgtactccgctgcctctatcactgcattctgaatctcctctgggaggctgttaaaataggtccggtccatcatgaaaaggttgcagctatatacatgattggttttgatccagtatttacagacttcatcaaaggaatagttcagagaatccgcaaaggggttttcctgtccctccacggtattctgctgcagtgcagtatatacctcgttcatagccagaggagtcggtgaggtattcagccactgccaagttttcaggtaaacctccagattgggtactctgagtttgaaacctttgaaatcatcaatggtctccattttctttgtagctgtgacaacgcggggaccacgataggctccgcccatcagtttaaatccagaagcttctccggctgcctcttttatttcatcccccagatcgctggaccatactgccatgaagtgatcagctccgctgtacatatatggcatagcgtcaatatttccaagttctgtaaatggggccagcactcccagagcttcacatatgatgtctgccacgccggcagacataccttccaagacttcggaggtactacccagactggctccaccataaaggtcgacctgaacctggccgcctgtcagttcctgaattttcttcgcaaaaagcactgcctgatcataacagttgtcaccctccgtggaatttagcgcacatttccacacatatgtggcttcctgcttttttccctctgaccctttctcactggcattattgcttccgcaggcactaagcatcggcaacagcataagtgctgcaagtaatccagcaaataatttctttttcataatgtcctcctgaaaataatctttccagtcgttgtatatcaaagcaatggcagcagacactgcgcagatttagtcagtgcaatgtcgccgctgggaaactgtaacacttccacactgacatagtcctcatagtccaccgcatgaagtgactgcatgattttcgggaaatccaatccgcagttcccgggatataggcgattgttatcacacagatgcacataggaaaaatatcctttactgcgttgaatttctttgaaaatgtccgcatcctggatattcatgtgaaatacatccaacataatccgaaaattttgatatcccacccggtctacgatgtctcggccttcagcggtagaattaataaaattgcactgtaggaagttgacgggctccaaagcgattgtaacacctttgtcctccgcataactggccaactggcgaaaggcatccacggcaagatctagagtcgtttccggcgggatccctggtactagttctccccgcacacggccaatattgacttgggcatgatagggagcagcacagtcgatgaattccttaaatcgtttgatgcaacgcaggcgattttcaggattcgaactacttaaagaaatatgatcctgtgcccatatctctcctgttgccaacatgacaacttccaaaccataggtgctagtcaatcggttgagcagttcgggatccaatttttgggggtcgcgaaccatcaattcgattccttggtatccattttccgctaagtgtcgaaaggagtcctccaaacttccctgataagctgtcagcaaaggactggattccaagtctggcatagctacctggtatgctagcttcataaacacacctcctatcctgttttagtatagggatgagcaaaacgcaagctttgcaaagccaatgcacaatatatagatagactttagtaagcccgatagtggcattattgtatagtctcatgagcaaatcaatattttgctcatccctatattttagaaacaagccttccttttatcggcacagaagcagtctgcgttcccgaactgtagacagaaccccgtcccatgcagtcaagaagccattatgaaacagctcaaaggccggatgtgaagaaaggtcagcggccaccagaccatctgcttcataggcacgtcggaaggccggaattttttctttaagctcttccaattcctccggactggccattgcatcgattcgactcagaatttcaggatttgtgcggttcatctcatcaatgaagttccaaccgcaggtaacatgcatatcaccaccgaccatttctgtgaaatgtctggcagctcggacgcctccccccatcaatttacagttaagcgtagaatacttttccttccaaatctgatagatttttttagacatttccgtccctgacttctcaaccaagtcgggagagatagaaatgtgattggcttccacatatttttttgcataattttcaaaaggagccgccaatgtggtcacaaacagcgtgggggccgaaccagcaatctgtactcctctggcatatgcctcaaacatctgtacagcatagtaattagaaacgcccgctgttgccaaaacacacctgccttcactggtcagcttttccatggctgcaatgccagctagcgttgctgaaaccttgacaacaatattgggggaaatttcatagaaacggtgagcttcctgcaggataaagtcaatgtcgtcatcccgatagggatttccctgaatggcgacccagcccttttcgccgccagtctcctgaaacaacggcaagaaaatctctgcgatttttgcgatcatttcctgataggccaacgccactactagatgatcatcctctgtcatccgcacatagcggtcgattgcgctgagcgctgcgtcctttgtctcctccgctttaagcatatgagaaagataggtggggttagaggttgctccaaaagttcccgcctcaagtcccttttttgcctcggaaggcgtcggattgttgacccacattctagtaggggtctgctcattgattcgttccagataggttttcatcggcttttccttgcatcctttctctttcatttttgaatttcgacatcagcgttgtaatgttgccatgttgtcatacagctcatggtcaaagtataacatctcttatgggaaaaagcaagcattttattgttgaaaatatacacaaagaagttgtatgcttatttgacaacttgactgggaatgatatataatacaatctatacttatcagcttaacgcagtcggacacaaaatgcagtggcggctcttgccatgcgcatgaagttctgatctccggtttttctacaattgaagcggaaacaagactcgtccagatacgcctgaagctgctggcagcgaccgtgattagattcccagtaaagatgacttttcagatgcaccctatatattgtaccttaattttgcaaggcttgcgttttgctcaaccctcaataaacgatattaggagaggattatgttaaaaccagttaatcacaacagtgcaagcagtcaaatctatgaacagcttctgcattatatcatctccggagagtggccggtaggaactcgccttccctcggaaaaagatttggcggagcagtttggcgtaagccgtgtccctattcgggaagccctccagcgcctgcgtgctattggggttgtacgttctctccaaggcagtggatcctttgtgtgcgggaattctcctttggaggcgatggaaaccattttgtcctgcaacgctgtttctcatgaacagatcgtggacttgttggagttccgaaagatttttgagccatactgtgtgcataaggtggcagaaaccgccaccaatcagcagctatttgaattggagaagtacgctccgtccttggaaagcatcaaagatcaaaacgatattcgaaccgtgacctttgaaatggatatagcatttcatcgcaacattgttctcctgaccaataattctctgtttatttccctttatgaagtaatcagcaaccttcgcctgagccatattgagtattttgtaggactgcgcatggaccatgaacgcattttggaagaacatcatgagatttatcgtgcattgatttgtagggatgcccaattggcagaaaaactgatgtacgatcatttgacccgtgtttccaacttcatgtaatctttgtataatttttctttgcaagttacttctaaaagaagctccgctttctatattatatgagggattccaagcttcaatcatggctggaatcccttgtagttactactctttttgagttttgctcatggctattactaataattacataggggttatggcaaagatttaccttatccgccattgcaaatccgagggcggtgcctgcagccgcgcgcaagtgcagactgatgtgctggttacgggacagcggaagacattgccaacgctgtcctcttctatgccagtgacctctcagattatatgaatgtcaacggcggactgtacatgtgagataacaccggcagttgtaccgttattcaacgctgaagaacgaaagcctctggaacagggacgaggagaatgtttgtggagaatatggtccgggcaacattgatctctaatgccggtcttttgctggaatatagggaagtgaagcttttggtggatgccatctaccataccacagatcccttcagcccccccgccagccgcgtggtccgcaatgctggccggagagcccccttttgacggtgtggatacgttgctgtttacccacggtcatccggatcacttttccccggagcgcctgatgcagtaccttcggtatcgtacggtcagacaggtagtgcttcctgttatggagccccagcattgggaaatcctgcagccattcttggaagagcggagaatccagtggactctgcttacagcacggatgcagacggcggactttcaaattccgggagggaccgttattcgaccctattttacccggcatattgataaagccttttggaatatgccgcatggctgctatttgatctccttcggcgaaaaacatgtcttgctgacagctgatgtggattatacaatagaaacctttgaacagatttcgtgtgttcacataaatgcggcgtttgttaatccactcttttcaatgcacttcgaaccggaacatttttaagggcacactgcagccagatcttctctgcgtctatcatatcccttttcaggaggatgaccggtggcaaatttgctcgatgctatcgcacaatttgcaccggtggaatcaagagcaagggaaggttgccatcttgagtgggccgtaccaatatgtggaattttagcggcaggagcgaacattatgaatcatccggtattttacttgaaaacgggttctcagaacccataagaattcgtcctaacgcaccgcgtggagggagactatctaatcctttggcagaatgacaataccatcgtcatcgggcaaaatcaaaatagcgaagaggaaatcaaccgcagctttgtagaagcacatcagattcatgtggttcgaagatctaccggcggaggcgctgtgtatcatgatcttgggaatttaaactattccttcatcaccgatgccggggaggatattaggaaacggcgatggagacaccctaaccggccatccgaaccaccagactgcggtaagaatccggatccttccgcgccgccaacaacacggaattatccacaatattgaactgccaatggaagcagccctgagccgcaaacgcccgtagcagttgctctgcaagacatccatctggcgtggctccgcaggcgttgcccaacccacctgcgcactgacagaataaagtgctggccagaattgccccttggaattttcgaaccgctccaactgatttgcaaacatgtccgtaatttcaacagccagtatgtcaacacggtcaacatcgtttccaaattttggaatacggtttaaaatgaattgccgcagtggctctcgatcccggaagttatccttcagaatccgagcaaactcattcagtgtcaatctttggcctcggtataccaactgccggacggcctccaaagaatccactaccgttgccgtgccgacagcaaccaatccagttgtattatagtgcgctccgccattcgtacagtcacgcccgttggcaacgcaatcgtcccaaaacagactgacaaaaggaagaggcaaaagctccttatgaattccatctgtgatattcgtctcttcaacctgtagggcgatcccctgttggaaatagctgtagaagcgattcatcaattgccgaaaagatttcggctctgcatcgtctgggtggaacatggagacgccagatttcgggtccgttccgtttcccagagtcaactctaaaactttcggcaagttgatatagccgccattgcaccgcgcccaatggccatgcacagagatttcatcacaacctacagcgatatagtcccgtgcctcctgaagaggaatgccgcaggtgctgaatgatgactgcatcattcagcacctgcggcattccatttccacaagcaatgctgccaactgcatgatccaaaaactcctgaggtgtccccgcgtgtagtcgtattgtaaaattgggctgatgcagttggatatgtctgtttgcatttagacagaggtaagacagaagatttgtgcagtcatgaccgccgcggtcaacccctcctacttcaatattctgccctgccacataatagcccgcgttgacctcggccgcgtctctgctgtccacccgcagaatctcgcagaattttagccagagcaggtcaaggagttcttgcgcctgttccaatgtgatcgtgcctgctgccaaatccgctttcagatagggccagcaatactggtccaaccgtccgaggctgatagagaatccgtttgattcgatctgaggaatcaactgcattagccaaaccatctgcaatgcttcatggaaagatgacgcaggctgcgcaggcacgcgggccaggacgcggctaattgcggtcaattccacctttctgcacggatccttctcctgcacggccattttcttctccagtctgcggtagcgctccgcaaaaacaagcacaccgacacaaacctcttcctcggcatcataaaaagccaattttccatcatacgcgggatcagatcggtttagtgtatcccgttgttttctcaccctttccaacattccgttaattccaaattgaagcagttgctgataattcattgccacatgcgcaaaaccgctcccctcatgaggatcagacaacagtccgcagacgtaggcgttctgaattgccgctgttctctgcctcatcaaataatcgtgcggtgtattccctttccaaaacggagcaatttccaacaggctcgcccgtacctctggtctaactcgtagccgattgtacttccgggtttcaaactggtcgatctcatccgtaaaattgatattcacttccggaaatacctccgcagagcgtggacgagaagctgagtgtccaacgatgacctcctggggctgaatgaagattgggagttcttccaatgtcctgcacaaagcctttgctctcagcaaaatcgtgggacatctcccggacaggtttcggtacacctctgtataaataatggctctctgacagcacatttctggattctcttccaaaaacatctcttttgctttaataacccgttctgttggctttgcggggagcctattgatgtcaaaatcagccatttttcagatagatcctttcctttttcgagtcaccaaaactaaaaccacaggcaacatacattaaaaccatgcgcttttgaaatataacgttttttgttatgattgttttaacatccgcatttgctgctgtcaaggtaaaatgcaagcctcaccccacaaatgctcccttttgcgctggctatattgcacaatctgcaccatggatatacagatacttgtcagaaaattaaccatattgtcttgctcttaacataaaattgacctcgtcttattttatcataaatgaagtgttttttcaaaatcatcttgacacgctcaatgtatgttgttataatcatgtcaaaaatatgatatataacaaattctaaacggaatatatatcatcataaatcataacaacatgtggagggtgcaaacatggcaacagtagttatcatgccccggcagggacaatccgtggaaagctgcgtcattaccagctgggccaaaaaggttggggacccggttcataccggcgagaccctatttagttacgaaactgacaaagccgccttcgatgaggaggccaaagtagacggcacactgcttgcagtattttatcaggagcaggacgacgtgccttgcctttctgaagtggcggtgatcggcacccccggagaggatatctccgctttcggtcctcatgcagatgtgtcgcccgctgcgccggaaacggcgcaggcagctactcccgcggtggcagccgcgcccatggccgtacaactcactgctcccacagcggctgccggtgtatccctcgggctagagtggccgcagagcggctccatgtggatttgaccggtgtgacccccactggtcctcatggccgtattctggagcgggatgtgctggcagccggccgcagtacctctgccgcagtggcagccggttctacagctggtataccgggaactgggttaggcggccgggtcacgctggccgatcagcaggctcctgccgccgtcgcgtccgagacatcctccgttctgggatatcacgatgaaaagatctcccacatgcggaagatcattgcggattccatgcacaattctctggctaccatggcgcagctcacccatcatagttcctttgacgccagcagcatcatcgcataccgcaaggaattgaaagccgccgaatctctggagcttcccggcattacctataatgatctgatactctatgcagtctcccgtgttttgaagcatcatcctgttctgaatgcccactggatggatgataagatccgttactttgaccacgttcacctgggcatggcggtggatacgccgagagggttgctggttcccacgattttcaatgcggataccaagtccctggcggaaatcgccaaggaaaccaaagaattggctgctgccgcccagggaggctccattagtccggacctgttgagcggtgccacattcacggtatccaatctgggaacactggatatcgagatgttcacccctgtgatcaatcctccccaaaccggcattctgggcgttgactgcatggtggaccgggtccgtatggccgacgggcacatttccgtttatcccgccatgggcctctccctgacctatgaccaccgagccatggatggcgcaccggcctctcgcttcctgaaagagctcaaaacagttctggaacatttttccgcactgctggcggagtgaattaaggagtgcataggatggaatatgatattattgttttaggcggcggccccggcggatatctggccgctgagcgggcgggacaggcccaaaaaaaggttctgtgcatcgaagaggcccatttgggcggcacctgtcttaatgagggctgcatccctaccaaaaccctgctgtatagcggcaaactgtatgcccatgccaagcacagtcaggcctacggtgtccatgccaaagatgttacactggatcacagcgccgttattgaccgaaaagagcaggtgatccgcacgctggtgggcggtgtgggcgctacactgaaagcctgtcatgtggatgttgtggacgcaaaaggcgtcatcaccggccgcaccgccgatggctgtactgttgaagccggcggtcaaacctatacagctaagaatctcattattgccactgggtcttcctgcgccgttcctcccattcccggcttgaaggaaggacttgcctccggcttcgtgctgactaaccgggaaatgttggcactgcgggagcttcctcaacatctggtggtgcttggcggcggtgtcatcggtctggaaatggcaacttattacgccatggcagatgtagacacgacagtcgtagaaatgcaggatcatatcggcggccccagtgaccgtgacatggtgaaaattcttcagaaaaactgtgaggcagagggcatgcacttcctgctgaacgccaaggttacagagatccgggagggctccgttatctatgagcaaggaggaaaaacctgcacactccctgctgataaggtgcttttgtccattggccgtaaacccaacaccgcaggcattggccttgaaaatgtcggtgtgctgacagagcggggcgctattgtcacagacgagcggatgcagaccaatgtacctggtatctatgccgtaggcgatgccaatggcaaagccatgctggcccataccgcatatcgggaagcggaggtcgctgtcaacaatattctcggaaaacgcgaccgaatgcgctatcaggcgattcccagcgtcctatatacagtgccggagctcagcagcgtaggtgagacagaggaatccgccaaagcgaagggctacgatgttaaggttgtcaagctgcctatgagctacagcggccgctatgtggcggaaaaccagggtggcgacggcatctgcaagctggtcttcgataaacgaacaaagactcttctgggtgcccaggcgctggcaaattactcgtctgagttcatcattgctgcaggcatctgtatggagctggagttgactgtggcggatatgaaggaaattgtgttcccgcatcccactgtggcggagatcctgcgggaagccatctgcaaatattgagccggcataacggcagaaggagagctgaaagatgtctaagcagttatttgtggaccccagagaaatgcgggcacccggcaaaattgagtttactgacattctggaaaatcagtaccagaaaaccgttaaggacgaagtcggaaacttccccagagaggatctgatccgaatctatcgggatatgtgctatatccgggaatttgaaaccatgatccaactcatcaaaaccactggtgagtatcagggcgttccctacaatcaccccggcccggctcatttgggtatcggacaagaggccgcttatgtaggtcaggcctaccacctgtccattaacgacttctcctttggctctcaccggagccacggcgaaattttggcccggggcctgcgagccgtagaaactctgccggaagaacagctccgctccattatggaggactttgatggtggaaaaatcctcagagttctgggaaacagccagctggatatccgggcgctgggccgggacttcctgctttacggcatgacctgtgagacctttggccgggaaaacggctttaaccgtggtttgggcggcagcatgcacgctttcttcacccccttcggcatctatcccaacaatgctatcgtaggcggctccggctctatcgcgcccggtgcggccctctataaactctccaaccacaaagacggcatcgttgtctgcaacattggtgatgcggccaccgcctgcggtcccgtttgggagggcatggtcttcagctccatggatcagatccgcaccctctggggcgatgagttcaccggtatgccgattctgttcaatatttggaacaacagctacggtatgggaggtcagaccaacggtgagaccatgggctatcagactcccgctcggatcggcgccggcctgctgcccagccagatgtacgctgagcgtgtggacggctacaatccgctggctgttatcgatgcttatgcccggaaaaaggacattatcaagcagcacggccctgccctgctggatgtagtgacctaccgcatttccggccactccccctccgactccagcagttaccgcaccaaggaggagattgaggcctgggaggcccaggattctattctggcttacggaaagcaactgatggaagctggtctttgcacgcaggcagacttagaggctattcgtactggcgtggcggcggatatgcttcgaaatatgaaactggccattgacgagactgtttccccccgcattgatgtgtttggaaaaaaaccaaatgctatcggtgaactgatgttctccaatcagactgtccgctccatggatgaaaatcgcaaagcggaaaccctgctgccctatgaggaatcccctcgggcacaggccatcgccaaaaaggtccgcaaggggctggatgaaaaggggaaccctgtcagcaagaacaaggtctatcagatccgggatgccattgcggagcccattctaaagaaattttacgaggatcccactctcattgctttcggcgaagacgttcgggactggggcggtgcttatgcggtctaccgcggcttcacggaaacacttccctatcaccgtctattcaactctcccattagtgaagcggccattgtgggtgcagccgttggctatgccatgagcggcggtcgtgtggtagcggagatcatgtacgctgatttcctcggccgcgccggcgatgaactgttcaaccaactgtccaagtggcagagtatgagcgccggtgtgctgcggatgccggtggtgattcgaatgagtgtaggttccaagtacggtgcccagcactctcaggactggtccgccctgtgtgcccatatccccggcctgaaggtagtcttccccgctacgccttatgacgccaagggtatgatgcagtcagcactgaacggcaccgaccctgtcatctttttggaaagccagcggatctatgacatgggcgaacgtttccacccagagggcgttcccgaggaggaatacgaaatcacgctgggtgagccggacgtaaaacgctgcggcacggacgtcaccatcctctccattggagcaacactgtatcgcgccatagaggccgccgatattctccagaatcagtatggcgtttccgccgaggtcatcgatgcccgttccctggtccccttccagtatgaaaaggtcatcgaatccgtgaagaaaacaggccgcatcgtcgtcaccggcgacgcctgtgaacgcaattctttcatgcgcaatctggcatccaacatcacggagcttgctttcgattatctggatgcgcccccggtcgtcgtgggtgcgaagaactggatcacccccgcccacgaacttgaggagtgcttcttcccccagccctcctggatcgtggatgccatccatgagcggatcctgccgcttcccggccatgtctgcagccacaactgcacggaactggagcagctgcgcgaaaacaagtacggcatctgattttcttccccaaattcaaaccatttttctcttcctttcatatagcgatgggaagcagtacccattacggtactgcttcccatcgcttataacgaaacccgccagatagactctggcgggttccgcggctttaccagtattatctgtatttgtgcgcaaacagctccttcatgatcgcactgcgctcctctggggtcaatccatcgttgacgctgaatacacggacattgtgcgcctctgcctctctcacaaattcaggcgtgagcatactgtcccccaccagtacatctacatcgtccagcgatgcaaaggtgaagggatggctccgtccgatctttccacaatccatcagcatcattgtgcaggctgctttccgaatcacccgctgcttcagctgtgcctcctgtaatgaaccgcttgtaaaaccaccattaaaggaatagccggaggcagccatgatcgccacatcaatgttcatgccatccagcatctgctcagcctgcggtccggagcatgaaagcgtcacgccgctgacctgtccccctaaaagtgtaatattgtagcgattcttctgtgccagctctgccgctgtgttggccgcgctggtgaccactgtatagctgccctcatgcagaaaataggtcagcgtcagaattgtggaccccgcgtccaaataatatgcatggcccggatataccagatctgcggcaatcctggcaatgtcttcttttgcagagacattctgctttgcgcggcaggtaaaattcgcttcttgtccggccatggggctctgggcagcaatcgcaccgccgcggacgcggatgatccgtccttcctgctccagcttggtcaaatccctccagagcgtcatcatggaacagtccccgatcaaagactgcagcgccgtattttttgcctcaccatgctccgtaatataggtaaggattgacatttgtcgttcatttaacatgaataaacctcaactttaaagaatcatttccccgtatatcgaatctcaagaggatgcgtccctataaatgccagcagcgttttcagatcccgaatgcccgtattggcaccgacacattgaataacgtgcgcggaagcagcggcccccaggcgaacacagtcctccatggacccgttccgcaagacgccgctgagaaagcctgccacaaacgcgtctcccgcaccggtagtctccactaccggaacatcgtagcagccgcagtaaaaggacagctgcgccgttttgcagaagcagccccggcttcccagcttgattaccacacatttcacgccgcccttcaggaagaaatccgccatggcttccacatcttccgtgcccgccaacagcatcgcctgctcctcactgggaagaaaataatccaagtaaggataacatggggataatatttcattccaccgtcctgttgggtctttagtcacatccatggacgtaatcacaccgatttcctgcgccattttcaacagcgaagcggccccgttggctccgtcaaagttgggcagatggaaggtgctgcttagttggagaattttgcactgccgcaatagggagagatccacatccgccgaagtaaactcccttgaaacaccgggaaagtaatagaatgcccggtttccctcctcgtcaatgaggatattcattttaccatgtggagtctctgaccggattgtgtggctcatatcaactcccgccctagtgcagatatccataatataattcccgcacacatccgacccaatgcggcccacataggttacggagttcccaatcactgccagatctacagaattgttcagcgcatcaccgccggtcttcagcaaaatctcctgtacattggtactatcgttgttaaaaaaggtgttagatacggggtgggtgataatatctactagagtttctccaatacacaaaacgtccatatttcatgcactcctaacgctagtttaatactgattccttcaaactttttcaaacatttctcggatattctcatgtcaaaaggcacaaatcatccttgctgacgcataaatccgcttttccaaaaaagaacgccccacagtcctttcaaaacagtaacggtggcaacgcccacaactgtcaatagtcatacaattatggctaattataacattttaatgttaattagtcaacattcaccacctgttttgttaattttgttagcgttcgtcaggaaaactgttagtgtcgggaattcgtgcccccgttttttgtcgggagcaacgaaccgctttttgtcgcaaaaccggaagctaatcgatagaatttcatagtaccaacaacccaaaatagcaaataagtattattatttttgccggtcagccagcagctcaacggcctttactttgccagtcgtatagaaactgtatccagctttttcctgcggaagctctcgccccgcagtttgaatcgcagcctcatcaatgatgcggtccagcgcacacagaagagtattgacgaatggcttctgcaccctttgaaagaaacggaagatagggacttattggaaatcgtggagtcccggtacaagcgaaactccacgatcttctgttcccagtttgacattccgggctggccgtaaaagttgtctgacccgctgctggctgatgccatctgcgaccgaatcgtccacgatgcctacgccataatcattggcggaaaagaatccatgcgtaagcggaagggtctgcaagacatctgactccggccatatttaatgtgcactgaataatagaaaaagccttgtagctgattcattctgaagccagtgaaatgaaataaccgcccaatcagcgcaaaaagtcttcgctgtcagagtgacatggagcaaggcagaaatcgtcctatagaatcataattgctaacatcattgaaagtccctgccgcctatggcggcattgacgcaagcatagcgtttgtatgacaaacgcgcttgctggggtaaaccccagtcccccatgccgcctgcgggcggaaacctttcggcagcattgccggaaagtagcatataaaatcgggttcggccatattgccaaacccgattgcaacgaggtctatagagattgaatttcctgcaatatgactggaaatctgctcgcaaagacaaagtcgatatgaggaaggattgacagaattgtcattccttccttacctgtttctatcgctcaaaagcgcttcagacaacattgtcaaaagcggtagacgctgaaaaccgggttcggtgaattcaccgaacccggtcagactttttgacaaggttgtctgaaagtaagggttggcaatcttgccaacccttactttaccagatcgtctcccgcaccgctcgaatcagcgtcaccacccatgacagcgccgcaagacccaccagcacaaggaaaatgccgtccgccagagcggtatgggccagataccacgggcggaataccgtgatgaccagtgcaccgtacagcagcggcgcagacaaccgtagcacctgtgccagacggacgatcccgtccagcagcgccagccccaatgataaaacagcatacatcatgttccgagcctccttcttcgatttgcggtatgttaccatcggcagacagactttacaacagcctgtctgccaatttttttcaccttgggtgtcaataagacacccaaggttggacggcgagggtgtctattgcacacccttgaccttaaatcttttacaggagcttttgattccggggtattcatcacgctgttttttcgggaggggtagtgagggggcatctgaaaaaacagaaaaccgctctcggcaacattgccggaagcggtttagaagttcaaagccgttggtaaacactcacccgttcgccccgtgccgccccgtgcggcgttcttccgtaatgggcagtgtccttgcccatcccctccggcagaggccccacaggcggcgtgtgggcaaacttagtaaacaatagaaaaaggagagcctatggagcaaaaagccaatatcaccatcaataaggagcatatcaccgtggagcggacgcagacagcctgcgggcgggagattcaagtcatctccgtgtttccccggcatggcagcgaaaccgtggaggacaagctgaaagccctggcagaactggactttcagcagggaaagctgtgtgcgtaaagtgctggacaattcaaaccgttcggggtattgtggtgtcgcaatgctctgaacggtttgacaaagaaaaggaggactgtatgaatcagtcaaaccaaatcaggaaaaccgctctttactgccgtctcagccaggacgatgggatagagggcgattcgaactcgatccagaatcaaaaagccattttacagaagttcgcggaagatcaccatttccccagcccctgcttctatgtggatgacggtttttcgggaggaaccttccaaagaccggcgttccagaagatgatctcagacatggaaaacggcgagattgggatcattgtgaccaaggatctcagtcgcctcggtagaaatcagcttcacacgggactctacatcgaggaacgcttccccatgttcggcgtccgctacattgccatcaatgacaatgtggacaccgacagcagcgagagcaacgacctcatgccgttcaagaatttgttcaacgagtggtttattcgggacaccagccggaagatccgtgcggtgctgaaggccaaagcggaacggggcgaacggctggggaccagagcgccttacggctaccgaaaggacccaggcacaaaaaaactaatcgtggatgatgaggcggcagctattgtccgcaggatctttgccatgtgcgccagcggcagtggccccagccaaattgcccgcattctcaagaaagagcagatcctgacgcccaccatgtacgcctacaccaggtacggcatcacgcacacctgtctggatacagcacatccgtataactggtctgacagcgccattgccaatcttctggagaacgagatctatctgggcaataccatcaacatgaagcacagcagcagatcctacaaggacaagcgaagggtcgaacatccaagagaggaatgcctggtctttgagaacacccatcccgccatcattacgcgggaggtctgggacgtggtacagagagtccgtaagaacaagcgccgtctgacaaagatggaagaacaaaacaagtattccggtcttgtgttctgtgctgactgcggctccaacatggtgctgcaccgggcacataccatgtccgccagctacaatcactttacctgccgcacctacaagaaagatggcgaagcctgtacgggccactacatccgggagtgcgttctggatgaggtggtgctggaggacttacggagagtaacggccatggcacgggaacatccggaaaagtttgccgcctatatcggcagcaggcagtccaccgaacttcagcgggagatccgcaggcaggagaaagaactggccgccatgcggaagcggaaagctgaactggacaccatcttcaagaagctgtatgaggatagcgtgctgggccgtatcaccacagagcagttccagatgctttccggcagctatacggaagagcagaatcaaatcgccgcaggtatcccgcagaaagagatggacatccaacgcctgcgagaaacggtgagcgggacggacggtttcctcgatagggcaaagcggtacacggacattgcggagctgacgctggaactgctgcggctgtttattgagaagatcgtggttcacgagaaagaggtaaagtggtctaagcacgcaccgcagaccgtggagatctactacaacggcattggctatgtcggcagtggtcggcaggatgtggaagaagcaccggaagcgccggaaccccagcaaacccaggacacagagaagccccggcaggcatcgtaaacacgatgacctgccggggtatcccaggaatcacttgttacccctgtgaggggagagcgaatgcctccgcgggtttttcctttcctcagaagagggccaggagctcttccagggcagctttcgcgtccgctccgctgtccctgcccggagatacggcatcgagggtataaagcccgttcttcaaaacaaaataggcgtctgcactagaaaagtcattgtagtaatcgctttccggggtctcggataccaccaatgtataaggaataccctcaccagtcacaccggaggtaatttcaaattccgcttccccgttccagctgccccctgtcccgggctccatgccgcttccctccggataaagcgaaactgtcatttgaatgcggatcggccccatgagatagccggtatctattgtcacgtgctgcagctcgcctttaatatttccttgcaaagcaaccgcgcaatggcgttggctctcttcattcagggtctccgcatcctgcgcgatggcgaagtagttggctgtctccagcaggctggacttctccaagggattgttcagagggaacccgataaactcctcacagtctgcccagcggtcaaaggtgcgaagccaatatcctggactggaattcaaatagagatcctgctcttccattttctgtgaaacatcctccatagcagacgcgacctcatccgaaaagctctccaaagggatcacgggaatctctccgtttacccgatagctggaactttcctgtcccaccagaacatcttccacccggacattccaaaaatccatggacaccgccgtcgctgccagcagcaccgctacgatggccgctaggatcagcacccgcttccccagccgccgttttccgggccggtccagggtgcccccctggcggatctgttcctccagcccgtccatagccgactcataggctgcgggcagggcccagtcctcccgctttgccattgcccgcaggcgggcgtccagctcatccatagtctccctccttcaagatgctccgcagcttctcacgtgcccggctcagccggacccgcaccgcccccggggacgtccccacgatccgggcgatctcctctgtgggcaggtcctcatagtagaacagcaccaccgcctcccgctggtctcgtggcaaggtctgcaccgcctgccaaagggtatcgtcccccgtctcccggcccggtattgccggttccgtgggcagatcatccaaagagactgtccggcctcgccgttggcagagacgccgggcctcattggcggtgatcttcagcagccaccggggcagcttctccttttcccgcagctgaggataccgctcataggcccggcagactgcctctgccaccgcctcctgggcatcgctgctgttccgggtgatactgaaagccagacggtacaggctggtccggctgtgatgcagcacttggcagaaccgctcccgctcttgctccggcagcgtcatgtccttccccccccttctcctgttctgcctgtatgacccagcagcgtggcaaaatgttacggtgtactcgcaaaaaagccgcctcgcaatgaggcggctcatattcgcttcacagcgggacgccgaggcccagccacaggacgttccggaccacgcagttggccaggaacagccccactaggaccatcggccagcggcggtcatagcgcaggacccagccccgctttccccgcagccgccacgcggtttgagaaaacagatagatcgctgccagggccagcgtgatcaccaccggcgtgtggtaccagagagccgcgcccacccgtccctgggctagggccatcagcgcccgtgtccctccgcagcccgggcagtagacatgccagtgctcccagacccagcagcggctgacagtgggtgcccccagcgcaaagcgccatagcagatatagcaacaccagaaccgccagggtgatccaggcggtcggataggcctcccggtctgtcatagaacctctctgcataaaatttcctccctgtaaacagcaaaaaggccgcgcagcgcgcggccctttctcctttacttcagcaaccggatctgtcccagcagaggaactgccttctcctctccattgacagcggagatgaagcccatcaccgcgcagatgaagcaaaaaatgccccacagccagccgatacatggaatgaagctcagcagccccgccagccagatcaccagcgcttgattcagatggaatttcgcgccctcccggtcgcccagtacaaaggcaatcaccagaccgatccaggtaatataagcgacaatacccgtcgtttttgcatccataaaaacacctctctttggttcagtggggttgtccatagtgtaccacggttttggaaagaatacaagcccgcgtcaggactcctccggcagaagcgggctgtacatcatgatggcgtcatttgcaaagaggaattcctcttccagcaggcccccctccaggtcatagatgcggcggtacagctcgttatgccgcacatatccgccccaggatgcctggtccatccggtggttcctctctacgatctcatagcggcagaccggaggtgccggggcccgccactctcccttcagaacctgctttcccacctggacacagagctggaagggctgttccgtgtcgttgcggatcatcagatcccggtggggataggcgcaggtggcgccgctgccgaagggctgggtccggttggtatccggaaagacatcgtgagagtgacggtaccgctccactaccgtcagcggcgtgtggagagtcatccagaaaatcagattggagagctggcacagcccgcctcccacatcgctgccgatccggcctagaaacagcaccatcccgtctcgatagcccttccggcgggtgggctttccgatcagccgccaatagctgaaggtctcgccgggatacaggacaatcccatccagccgggccactgcaagccggagattagccaccttgttttcctggagttcctgatcctcccctcgcagatggcggtacaagggtgtggcgtgtgaaatcagcatatacggcaggcgctccgtctgacgctgtttggcccagtgaaaccggggcgacatccacagaagacggcgccgtccgccgtaatagagttttcccagacgcaaacgcagccagctgcggtgaatgggcggccagagctgtcgattattgggatctaccatgggacctcctccctatttcccagaccgttcgcaaataaagacgaaatcagaacctaaaacgattttaaagtgttcggtcccataaatcctcacaaaactgttacaaacaataacaaaaaagagacagtcaattgactgtctctcagtgttggcgctacctatcttcccgggccgtcaccagccaagtattgtcagcaggaacgagcttaactgccgtgttcggaatgggaacgggtggaccctcgccctaatcagcaccaactctatgtcatccggtcttgccggagaacaaactgtattatattgtatttcgcttcccttgtcaagaactttcgcccttgaaaagtctggtgacccgtaccggattcgaaccgatgttaacggcgtgagaggccgctgtcttaaccacttgaccaacgggccatggtgcaccttcacggactcgaaccggggacccactgattaagagtcagttgctctaccaactgagctaaaggtgcaaatcccttgagcatgcttccctgcaccctcaaaaccgaacaatgtgacgctgctttcaggctcgcctgctttctcgtaggtcaagccctcgggctattagtaccggtcagctccatacattactgcacttccacctccggcctatctaccaggtagtcttcctgggcccttaccctctttcgaggtgagagatctcatcttagggggagtttcacgcttagatgctttcagcgtttatctcgtccgtacttagctacccagctatgcccttggcaggacaactggtgcaccagaggtacgtccatcccggtcctctcgtactaaggacagctcccttcaaatctcttccgcccgcaacagatagggaccgaactgtctcacgacgttctgaacccagctcgcgtgccactttaatcggcgaacagccgaacccttgggaccgaattcagccccaggatgtgacgagccgacatcgaggtgccaaacctccccgtcgctgtggacgcttgggggagatcagcctgttatccccagggtagcttttatccgttgagcgatggcatttccactcacataccaccggatcactaactccaactttcgttactgctcgacccgtcggtctcgcagttaggctggcttctacgtttacactcactgcacgatttccgtccgtgctgagccaacctttgagcgcctccgttactctttaggaggcgaccgccccagtcaaactgcccgcctaacagtgtcccccgaccggattcacggccgcaggttagaaattcagcaatccaagagtggtatcccaccggcggctccacaagagctgacgcccctgcttccaagcctcccacctatcctgtacatgggttaccgaattccagtattaagctgcagtaaagctccatggggtctttccgtctagttgcgggtaactggtatcttcaccagtactacaatttcgccgggcgggctgttgagacagtgcccaaatcattacgcctttcgtgcgggtcagaacttacctgacaaggaatttcgctaccttaggaccgttatagttacggccgccgtttaccggggcttcaattcaatgcttcgcttgcgctgacatctcctcttaaccttccggcaccgggcaggcgtcagcccatatacgtcatctttcgatttagcatagacctgtgtttttggtaaacagttgcttgggccttttcactgcggcctcttgcgaggctccccttattccgaagttacggggtcaacttgccgagttccttaacaacccttctcccgttggccttaggattctctcctcatctacctgtgtcggtttgcggtacgggcaccttagtatccatcagagcttttctcgcctctcagcatcgcggacttcgctactatattttcgctccctttcgcccgggtcaaccaacgcccgggttccgctatccaaaagtgtccctctgacttaaagttcggtggctacggaatttctaccgtatgtgcatcgactacgcctttcggcctcgccttagctcccggcttaccttgggcggacgaaccttccccaagaaaccttagattttcggccattatgattcccacataattctcgctactcattccggcattctcacttccatgcagtccaccgctgcttccgctgcgacttcaccccacatggaacgctcccctaccactgtcttacgacaatcctaagcttcggttagatgcttagccccgttacattttccgcgcagagtcactcgaccagtgagctattacgcactcttttaatgagtggctgcttctaagccaacatcctggttgttttcgcaactccacatcgttttccacttagcatctattcgggaccttagctgtaggtctgggctgtttcccttttgacaatgaaacttatctcacactgtctgactgctatgcatcaattagccggcattcttagtttgataggcgttggtaaccttatcggccccgctaccattcagtgctttacctccggtaatctaacataacgctagccctaaagctatttcggggagaaccagctatctccgagttcgattggaatttcaccgctacccacaagtcatccgccaccattgcaacgggggtcggttcggtcctccatggggtttcacccccacttcaacctgctcatgggtaggtcacccggtttcgggtctatggcaacgaactttacgccctattcagactcgctctcgcttcgcctccggcactgaatgccttaagctcgctcgttactataactcgccggaccgttctacaaaaagtacgccatcacacgttaacgtgctttgacagcttgtaagcacaaggtttcaggttctctttcactcccctcccggggtccttttcacctttccctcacggtactgctcctctatcggtcatcaggtagtatttaggcttggagggtggtcccccctgtttcccacggggtttcacgtgtcccgcggtactctggattcagtcgcacggccttctctttcggatacggggctctcaccctctatggcgggccttcccagacccttctcctagataacttccgctaaatgactgtccgcaaccccgaggaataaatccctcggtttggcctcttccgcgttcgctcgccactacttgcggaatctcggttgatgtctcttcctcgccctacttagatgtttcagttcaggcggttcccttcctacgcctattttgttcaacgcaggatgactggatattgtccagccgggttgccccattcggatatccccggatcaatggatatttgctcctccccgaggcttttcgcagcttgtcacgtccttcttcggctcctgatgccaaggcattccccttgcgctctttccagcttgacctatcgccgttctcacagcgacttgtcagagaattcttggttctctttgagaattatgcaggctttacaaagatcgaaattgtatgtcaccctgcatcctttcggatgctgttccacaatcaatttgtttcctctgtgtctccacagagaaacctctctgttgccttacttgcttttgtcacattgttcagttttcaaggtgcagatcgccgtccgcaagctttcgcttgtctccggcacagcttccaaccgcttttgcagtcagatttgaagatccgatctttcgatcaggtcttcaaatccaaaggcaaatcgcctggtgggcccgagtgggctcgaaccaccgaccttacgattatcagtcgtacgctctagccagctgagctacgggccctcgtcttggacgaggtgacgctttattctcttggtggagatagtcgggttcgaaccggcgacctcctgcttgcaaggcaggcgctctcccagctgagctatatccccttctatctcccggcgtacgccctctaaattaaacaacgtaactctttttccgctccagctgaccaggaattccaggcagagcttgctctgcccaggtctccttagaaaggaggtgatccagccgcaccttccgatacggctaccttgttacgacttcaccccaattatcgaacccaccttcggccgcgccctccttgcggttaggctacggacttcgggtgttcccgactctcatggtgtgacgggcggtgtgtacaaggcccgggaacgtattcaccgcggcatgctgatccgcgattactagcgattccgacttcacgcaggcgggttgcagcctgcgatccgaactgggacggcttttgggggtttgctctgcctcgcggctttgcctccctctgttgaccgccattgtattacgtgtgtagcccaggacataaggggcatgatgatttgacgtcgtccccaccttcctccgttttgtcaacggcagtctcgctagagtgctcttgcgtagcaactaacaataggggttgcgctcgttgcgggacttaacccaacatctcacgacacgagctgacgacaaccatgcaccacctgtctctactttccccgaagggcacctgatgtatctctacttcgttagtaggatgtcaagccctggtaaggttcttcgcgttgcttcgaattaaaccacataatccaccgcttgtgcgggcccccgtcaattcctttgagtttcaaccttgcgatcgtactccccaggtgggatacttattgtgttaactgcggcacgcagggggtcagtccccgcacacctagtatccatcgtttacagcgtggactaccagggtatctaatcctgtttgctccccacgctttcgcgcctcaccgtcagttgccgtccagttatccgccttcgccactggtgttcttccttatatctacgcatttcaccgctacacaaggaattccgataacctctccggtactcaagacctacagtttcaaatgcagtttggaggttaagcctccagatttcacatctgacttgccggcccggctgcacgccctttacacccagtaaatccggacaacgcttgccacctacgtattaccgcggctgctggcacgtagttagccgtggcttattcgtcaggtaccgtcttctactcttccctgacaaaagaagtttacaacccgaaagccttcttccttcacgcggcgttgctgggtcagacttgcgtccattgcccaatattccccactgctgcctcccgtaggagtctgggccgtatctcagtcccaatgtggccggtcaacctctcagtccggctactgatcgtcgccatggtgggccgttaccccaccatctagctaatcagacgcgaggccatcttccagcgataaaatctttgacatgcccgggatgccccggtcatgcgtcatgcggtattagcagtcgtttccaactgttgtccccctctggaaggcaggttcctcacgcgttactcaccagtccgccactaagcattcctatcatttggccgaaacctcagtcaagggtgctccgttcgacttgcatgtgttaagcacgccgccagcgttcgtcctgagccaggatcaaactctctataaaatggtatctaaacgaaccgtagtccgttcaaaccttcatagagctatttgtcatagcttcatttctccatcccaccggtaattgactcaacccagtgagacggctttgtcctttggcaaactcatctaaatgagctcgccttctggtgcttccttttcgttacgttgtttaatttacaaggtgcacgccgttcccggcggtgagatttactttaccacaaagttcttactttgtcaacacattttttcaagttttttcttgaagctctgcgttttggtgtttcactctcacgcccgacagcttagttagaataccagagcttgccagaaaagtcaaccctcttcttctgcttttgttcatttttttctcttgttttccggattcaccttctttttcgtgcttaataagtactcaaactgatgagactccttctatcataagttatacttattgttaatattgatttaacacgcttcttttgtcgattttatccagtttaaataaagctgcgaaaaagagacgcgggtttgattcccgcgtctcttccctcatcgcagcagcagcggctgtatctgttcgcctcgcagagcggcttccaccgtctccgggattttggagaagtccgccaccagggaactgggtttcgcccgggcgttgtcctgcccgaagggaacgaaatagtagttcttccgcaccagcagttccccgatattccgggcgccagccgccaggccgtcgttgctggccatggcaatcaccaccggcctcccgttccgcagatgggccttggccgccatcgtaaccgccgtatccgtgatgcccgccgccagcttggctatggtattccccgtagccggggcgatcaccagaacatccagcagccccttgggaccgatgggctccacagacgggatgtcacaaagcacctcatgccctgtcaaatcctccaaccgctccatcaggtcatcagaggtcccgaagcgggtatccgtgaaggcggagatctccgacgcgatagggatgactgtctcatacagctgcaccagcttctccagctccgccagcaccttttcatgggtgcagaaggagccgcacatcgcaaatccgacccgttcttttctcacacagggtcacctcgttcttttaaaatgtagtcgactgcgtcccggatagccaccgccgctgcggcaggcaccatccgccccggcagggagcgggcccatacgtggggcagtcccagctcctctgcagcagctaggtcgatgccctggacggaggccagctccacacacaggcagcccttcggcagctgcgccagcagcaggtggcccaggacgggcgaggggaccgtgttgaacacggcgccgaagtcacacagcgcaccatcgaggcgtccggtctccagcgcctgccagccataggcacggatccaagccaggtccgccggttttctggcagtgactgtaacatgggcgcccagcccatgaagccgataggccagcagctttccgatccgcccgaagcccagcaccaaacactccatccccaggagcgtccggtccagatgctccatagcgatctggagggccgactccgccgtggccgccgcgttggcaacggtcagctcttcccgctggaagtagtccaccagcgtcagcccgcagttctcagcctctatctgctgggcgggacgaacctgccctgccagcaacagctggccgggactgaaacggcggaacagcgcactggtgggcagatcctccgtctcactgtttagtatcccgtcctcccggcagagcggcagcggaaggatcaccacgtccgccgccgctgcctgcgcaggcagatccgggcatccggccactccgctggtccagaccgtgcgcccttcctccgccagcagccgtgcaagctctgcctgccgccgatctccgccgatcacgccaaaggtcttgttcatccggcattccccctcaagccatggtatgcacggcgggggcggcggtgattgcctttcctgtttggatgtgatacgatacatgtggtcaaactctcccgaaaggagttctcaccatgaaatttccctatctgctctttgacgcggatgacaccctgttcgactttccaaaagccgcggcccgtgccttttccgccatgtgccggagcaacggcgttccggatacgctggatacccgcgccctctaccaccggatcaaccaggagctgtgggcagcctttgaccggggagaggtctccaaggactatgtgacgttggagcgttttgtgcgcttttttcaggcgttgaagctgccgcgggacccagacaagtgcaaccgggattacctcactgccctgggtgccggggtctatcccctgcctcatgcggaggcggtctgccgggaactggtccgccgggggcacaagctgtacatcgtcaccaacgctgtggcctccgtccagcgcagccgcctgcagggcagtgtgttcgcagatctcatcacggacgcctttatttccgaggacgccggagcctccaagccggacccggcttattatgcctatgtccgctcccgcatacccggcctgacgccggagaacggtctcgtgatcggagactccctctccacagacatccggggcgccaacaatgccggacttccctgctgctggtacaatcctgctggaaaggcccggccggaggacctgcggatcgactatgagatccgggacctgcgggagctgctggatattgtctgagagtacgctttcctgtttgaatctgaaaaatcccggtgagtgccctccaagacgcctcaccgggatcatttcatcttcaaaactgagagccgcgatcagaaacaataagagaccggatccctccggtctcttaccctttctctctgcgcaggaacgcgcatggccgggtgccccccctcacagccacgccgtctccagcagttcatccttcttggcccgggtcatcagctctgctaccacgccccggatctgcttgccctgatagaggacttcgtaggcacagcggctgatgggcatttccacgcctacccgctcactgagctggtgaatgctctccgcggcgaagtatccctccaccacggcgcctacttcctccatggcctcccggggcgttttgccttggccaatgaggatgcccgcccggcgattccgggagtgcatggaggtgcaggtcacgatcagatcccccataccggccaagccgccgaaggtctgccgggagccccccagcttctcccccaagcgggtaatctccgccatagcccgggtcatcagcagggctttggtattgtcctgatagcccaagccgtcgcacacaccgcagctgagggcaatgacgttcttcagcgccgccgccaactccacgcccacgacgtcgccgctggtgtacacccggaagtagtcgttcatgaaggcgtcctgcacaaaacgcgccgcatccacatccaagcaggcggccacgcagccggtgggcaggcggatccccacctcctctgcatgggaagggccagaaagaactgctactttacagatattccccgtctcctcctggatcacttggctgagacgcagatttgtgtcccgctcaatccccttggaaacggacaccaccacagtcttctccgtgagatacggggccattttttttgctgtctcccgcacggcgaaggagggcggtgcgctgaccaccaggtcggcgcccttcaagcagtccaaatccccggtgatgtggagggattccggcagatggacgccctgcaaaagcgggttctcccgggtccgggccatctccgccgccttggcggggctgtgggaccagagataggtctcgtgtccgttgtcgcacaggatctggctgagggccgtgccccagccgccggagcccaatacaactgttttcatctgtattcctccccctcaaattaggaatccggagttagaaatcgagctgttccgcctatggcggaacaattccattttgtccggctctgccggaccgcaccatgccgcattcctaattttttttgcggtgtacgctgaatttattctcgttgccatggataaggcggacgatgttgctccggtgcttccacaaaatcaaggctcccaggagaaacgccaggagcacgatgaccggatccggatagaaataccaagtggcaaaagggaagctggccccagcccagacagatcccagagatacatacttcgtcagcaggaataagagcagaaatcccacccagaccaccaggccgatccgccagtcgatcatccagacgatggtgccgccggagaggatgcccttgccgcccttgaagtggaacatgcaggggaacatgtgacccagcaaacagaacagggcagcccagtatttgaacaagaccacataatagaccgtcatctccgtactcagcggcatatccggcatcatcctgggatcaaacccgccgccgatgtgagccgcgatcagaaccgctattacggctttaaggacatcacataagattaccacaaaagtcagcggtccaccaaaggtacggtaaaaattggttaatcctgcattgccgctgccatgcctgcgaacatcgtctcgcaggatgtatttagaaataatgaccgccccattgaaacagccgcagaagtaggcgatcgcagccaccagccacagttccatccgggaaatgagaaaccataccactgtgcccatcctcacccctccttctcgccccgctggcggatggagagggtgataggcgtgccctccaggccaaaggtgttccgcaggcagttctccagataccgctggtaggagaagtggaacaggcggctgtcgttgcagaacaccacaaagtggggcggccggatgcccacctgggtcatgtagtagatcttcaaccggcggcccttgtcggaggggggctgaacccgtgtctgggcatccgccaggacgctgttcagcataccggtggtgatccgggtgctggcctggttggagacatagtcgatcagctcgaacagccggtccacccgctggccggtcttggctgagatgaacaggatgggggcgtaggtcatgaaggccaggccgttgcggacctcttcccgcatcttgtccatggtcttgccgtccttttcgatcagatcccacttgttgaccacgatgatgctggccttcccggcttcgtgggccaagcccgccaccttggtgtcctgctcggtgacgccttcggtggcgtcgatcaggatcaggcacacgtcgctgcgctcaatggccagggtggcccggagaacggagtacttctcgatgtcctcctccaccttggacttgcggcggatgccggcggtgtcaatgaagacgaacctgccctgatcgttttcaaagtaggagtcgatggcgtctcgggtggtgccggccacgttggagacgatgacccgctcctccccaggatcttgttcaccagggaggacttgcctgcgttgggcttgccgatgaccgccactttaatggcgtcgtcctcctcctcttcttcctcctctggggggaagtactggagacaggcgtccagcaggtcgccggtgccgtggccatggacagccgagacagcgatgggatcccccagtcccaggttgtagaactcataaaagtccgggtccgggacaccggtggagtccattttgttcactgccagcacgatgggcttgccgctgcgcagcagcatgttggccacctcctggtcagaggcggtgaggcccgtgcggacatccgtcagaaagatgatgacagtggcgttctcgatggcgatctgggcctgatcccgcatgaaggacaggatctggtcgtcggtccggggctcgataccgccggtgtcgataagggtgaaggaccggccgttccagtccgtctccccatagatgcggtcccgggtgacgcccggggtgtcctccacaatggagaggcgctttccaatgagtttgttgaacagcatggacttgcccacattgggccggcccacgatggcgacgatgggtttcaccggcgctcacttcccttctttatcaagcagacatacatggtcatattatacccagtgaccggcgaaatggcaagacgtcctccgatttttacacagtatggacgcagaaaaaggagggaagatgttgctcttccctcccgatccacagggcacgtcttatttcgccaccacggacttgacaaccttgacctcgcggccgttgtaagtaccgcactcctggcacattctgtgaggcaggtgcagcgcaccgcatttcgggcatttgacgaggccgggagccgccagcttccagtgggagctgcggcgcttgtcgcgtctagctttggatacttttcccttaggtactgccattgtgacacctccttgatctttcaaaggcaacggagtcgcccccggccttattcattcgttctctctgttctctaaaagctttgccaggaccgccagacggggatccgtctccttcccgcaggagcaggggccgaggttcaggtcggcaccgcaccgggggcacagtcctttgcaatcttccgaacacaatgtcttggtgtccattccaaggatgaacgccgtgcgggccagatcgcccacatccacttccccatcctccagcaggacgatctcgtcgttgtcctcgttctggagctcttccgccaataggcagcgaaagggaacggtcttgtcctgaagaaacgccttgccgcaccggtcgcagaccgcgtccagcgtggtccgggccgtcagctccagctccaggagatccgcggtgttgctcaccgcgccctccacctccacagggcggctgatgggatgccgtccggcaaattccacgtcggacaagtccagagaaaactggaacgtcaggcgcttgccaggggcatgcagtatgggtcttacatcaaaacgcataagctacctcgtaatgacacgaatagtattataagggatgtgtgcccggttgtcaaacaattttttcatgtttttgccgtttccgggcaaattttttcgtttccgggcaggcgctctgttcagctctcctcttcccgacgcttctgccagccggtgatgtcgatgcccaggatcacattgcggaagccctcctgcagccgggcataggtggtgatgttgtagatgtccttgggccggcgggtgttccagccgtcccgcagccgctccgccagctcttggcacaggggctcctccagtcccagcagcatgggggaaagatacgtcaccagcatctgcttttcccgggcctggaccatggtccggttccaggggcgctggcgtttccaccctgcctccagcaggtccagcagctgctccgccagtacccggcggccgtcagggtcctccgccgtctcccggacggcctccatgtacagtggtccgaatcgctccgtgtaggtccggaaggcgctggtgtactcccggcgggtgaaccgctcgttgtaatagcgcgcctcctgcacggcggcgcagagctcttccagcttcattcctcgtcccgtcccttctggtccgcttcgggtccgacctgttctgcaggtgtcgccggacgcttctgctccggcagggcgtcgtcctggctccagctatccgggtcgtccttgtgagccttggcgtactggtacgccttccactcccgccaaagcaccatcgcccctgccgcggcgaacactgcgcccgccgccgcgttcagagccacggtttcggcggtcccgtcccagatgcccttcatcagctggtaggccagatacagcaggtagccccctgccaagacccggaaatagttcacccagccccgctgtttgtttccgtcatgctgcgccatacgtccagtttctcctaaccgattcaaaaaattctctccccgctttacaagcgcccggcaaacaggtatgatggtagcatcaaatacttgcccatcggaggatgccatgcgggaactcaccattggaaaaaacgacgccggacagcggctggaccgctttgtggccaaaagcctgcccctgctgccccccaccctgctgcagaaatacatccgcctcaagcggatcaaagtcaacggcaggggtgccaagcgggacacacggctggagtccggcgatattttacaattatatatcaacgacgagttctttgacaagccctctgaggaaaacatctttctcaccgtgttccgtccccagctggacatcgtgtacgaagacgagaatctgctgctggtgaacaagcggccggggctggtggtccacgccgatgagacggagaaggtcaacaccctcatcaaccacattcaggcctacctgtaccagaaaaaagagtggaatcccaaatgggagaacgcctttgcgcccgccctgtgcaaccggatcgaccggaacaccggcggcattgtcattgccgccaagaacgcggagaccctgcggatcataaatgagaagatcaaaaaccatgaggtggagaagtcttatctctgcatcaccgtaggccgccccaagccagtggaggggaagattgcgggctttcttttaaaagatgaggcgaaaaagcaggtggctttctatcgccgtcccattcccggcggaaagactgccgtgaccctgtaccggactctggagacccggggcccgctgtctttggtagagtgtcggctgctcaccggccggacccaccagatccgggtgtccatggcggagatcggctgtcccctgctgggggacggcaagtacggccggggggatgtgaaccgccgctacggcgagacccggcaggccctgtattcctaccagctggccttccctttccccacggacgccggggcgctgaattacctgcggggcagggtcttcaccgtggcggatgtgcccttccgggacaagtattttcccgcgccggaaactccttaaaaaattcccgtaaaaccccggcgaaatctttgattttgcttgacttttcgccacacatcggatatagtttgttattgctgaatttcgacgagaaaggttccccctcaacagagaaaagaggcgtttcattgtaatcaaaattattatgaaatgggggaggatacatgtccaaagagttgattcgtctgcggaacatccgtatggcgtttgacgacgaagtggttctcaacgatttaaacctctatatcaacgacaaagaattcctcacactgcttggacccagcggctgcggcaagaccacaacgctgcgtattattggcggcttcacgacccctgtgtcgggagacgtcctgttcgacggtgtgaggattaatgacgttccgccctatcggcggcagatcaacacggtgttccagaaatacgccctgtttccccacatgaatgtgtttgagaacgtggccttcggcctgcggatgcagaagcggccggacccgaaggatccctccggcaagcgccgggtaaagatcccggagacggagatccgtcagcgtgtgctggaaatgctggaggttgtcagcctgaagggctttgaaaaccgcaagccggacgccctgtccggcggccagcagcagcgggtggccatcgcccgggccctggtaaaccggcccaaggtgctgctgctggacgagcccctgggcgctctggatctaaagctccgcaaggacatgcagctggagctgaagaaaatccagcagcaggtgggcatcaccttcatctacgtcacccacgaccaggaggaggccctgaccatgtccgacaccatcgtagtgatggacaagggctgcatccagcagatcggcacgccggaggatatctataacgagcccaagaacgcctttgtggcggacttcatcggtgagtccaacatcattgacggcgtcatggtccgggacaagctggtgaagatgtacggccgggagtttccctgcctggatggcggctttgctgagaacgagccggtggacgtggtcatccggcccgaggacatcgacatcgtccccatggagcagggacaactggtggggactgtcacctctgtcaccttcaaggggatgcagtacgacatcatcgtggatttccggggcttcaaatggcttatccaaaccacagaccattcccccgtgggcgcccggatcggcatcaagatcgatcccgacggcatccacattatgaaaaagagtccgtattccgggatgttcggcgattactcctccttctcggaagaatatgaggagatgagcgacgccaactgggaggcggatgaggaggagagcgaggatgaaaaataagctctcattgttcgccgttccctatgtgggatggatgtccatcttcgtggtggcgcccatcatcattatggtggtctatgccttcagcaccgccgccggggacttcacgctggagaacttcgcccgcatgggtacctatacagcagtgttcacccgctcgtttaagctggccatcatcgccacactgatcgctctgctgatcggatacccggtatcctatatgctctccaaggaggggccgcaggtgcagcgcatcgctatggtgctcatcatgctgcccatgtggatgaattttctgctgcggacctattcctggatgtccattctggagaacaacggacttttgaaccagctgtttcagcagatcggcctgatcgacctttacaaccagatcgctatgcactttgcatctgatcccgccgcgtatgtccccatcgatcacttccagatgatcggtacccagggcgccgtagtgctgggtatggtgtacaactacctgcccttcatgatcctgcccatctactccgtgctggtaaagctggaccattccctcattgaagcggcccgggacctaggcgccagcagcgtgcaggtgttccgcaaggtcatcctgcccctgtctttgccgggggtgctctccggcatcaccatggtgttcgtgccctccgtgtccaccttcgccatctcccgtctgctgggcggcggcacccagatgatgctgggcgacctgatcgaacagcagttcctgggcggggcctataatccccagctcggggcggctatcgcgcttgtgatgatggccattgtggtggtgtgtatgctggtgatgaaccgtttcggcgacggtgaggaacaggcggtgatgctgtgaaacggaagcatctgctgggaaaccgcatcttcatggcgttggtattcgtattcctgtatgcgccgattttcattctcatcatcttctccttcaatgccggcaacagcagcgcggtgtggaagggcttctccctgcactggtatgcggagctgttccagaaccgcctcattatgcagagtgtctataccacgctgctggtatccgtgctttccacgctgattgccactgtggcgggcacctttgcagccattggcctggccagtatgcggcggcggtggcgcacgcccctgatgacggtgaacaacattcccgtcatgaatgcggagatcgtcaccggcgtctccatgtgtctgttgttcgtggcctttttcggcctgtggaaggcctttgccgtctggttcaaccaggcgcaggataccttctggatggaggagaacatctatcttggcttcggtacactgctgctggcccatgtgaccttcaacatcccccacgttatcctgacagtgatgcccaagctgtgccagatggacaaaaacctagtggacgcggcccaagacctgggctgcacctggatgcaggccttctggaaggtcattatcccggagatcaagcccggcatcatctccggcgcactgatcgccttcaccatgagcatcgacgatttcatcatcagttacttcaccgccggttccggcgtgtccactttggccatgaccatctattccatgacgaaaaagcgggtcagcccggagatcaatgccatttccacgctgctcttcggcgctgtgctgctgctgctcatcatcatcaatgtccgggaatcccggcaggagcgcctgcgggagcgagcccgcgcatgactatcggtcccacggcctgcgggtcttgagatacgcattcaaatcaacactggaggaatgatcaattgaaaaaaatggtagccttgactctcgccttactgatggcggcgagcctgttcctgtccggatgctccgtgcgcaaggacacctctgactcggaaaattccggcagcagtaacggcagcggcagcggggaccgtgtggtcaacgtgtgcagctggggtgaatatatcgacgagtccctgatcgaccaatttgaagaagagaccggcatcaaagtcaactaccagaccgcagagagcaacgaggtcctctattcccagctgagcatgggcggcgtggactatgacgtcatcgtcccctccgactacatgatctcccagctgatcgaagaggatatgctggccgagctcaattatgataacatccccaattttgagaagatcgacgaccgcttcaagaatctgtcctacgatccggagaacaagtacaccgtgccctacacctggggcactctgggcatcatctccaacaccgccaaggtgcaggagcccattaccagctggagcgccatgttcgatccccagtacgccgggaacgtgctgcttatcaacaactcccgggatgctctgggcatcgccctgttgtacctggggtactctgtgaataccactgacgaagcggagattcaggaggcttaccagctcatcgccgacgccgtaaagaacggggtgtatcagggaaaggtcatggacgaggtgtttcagaagatggagggcggcaacgccgccattgccacctactatgccggtgactatctgagcatgctggaaaacaacgaagatctcgcctatgtagtgcccgaggagggcagcaactggttcgtggacgccatgtgcgttctcaaaacctcccagcacaaggaggaggcggaggcctggatcaactttatggcctccactgaggcaaacctgcggaatatggactatatctggtacgcctctcccaacgctgaggcgctggagacctatcctgcctactatgaggagacctacggagagcccctggatcccgctctctatgagatcatggccccctcccaggaggtgctggaccggtgtgaggcctacttggtcctccctgctgagacgcgcaccctctataacgacctctggacgcaactcggtatctgagctgtaaaatgcggcaccggaacactacccggtgccgcttctttttcccttgcgcattccactgctttcctgtacactggaaaggcggaagatattttaccaaggaggaatcctctcatgattttgattggaacaaaatgccgcctggagcaaactgttacggacgcccttaccgccgctaacgtgggttccggtgccctgccggtgttcggcacgccctatatgtccgccctgatggaaaatgccgccatgacctgtctgcagagctttctggaggagggccagggcagtgtgggcacccatctggacatctcccacgacgctcccactcccatcggcatgaaggtgtgggcggaggcagagatcaccgccgtttcggaaaacggcaaaatggtggacttcgctgtgaaagcctgggatgagagcggccccatcggcagcggcacccacacccgggccatcgtcaagaacgaaaaatttctggcaaaatgcaatgccaagctggagaagaagtaattctttccacatggacaaaacaagggaggacccggaatgggtcctcccttttcttctgctatcgcggtgccgtggggaaatcgctcccacggggatcaaaacagcgtcagctggctggtctccgccatcccggcgaaggctcccagcgccttcagctgctcaatatgggtcttggacagcttgttgcagcacatggcgaactcctcaacggagacgaactccttcccattccgcttctccactgtgtcgatggccgccgcctctcccaggccgtggaccgttgtgaagggcggcagcagaccgttctccgtcactttgaacttggtggcatcggactcataaatgttgatcgtgtcgaagtggaagccccgcaggtagaactcatagcacacctccagggtggtcagcaggttctgctccaccgccgtggcgtccttgttgttctcgatctcccggatcttccgcttcaccgcatcctttccggcacagcagtactccgcatcaaaggccttggcccggacggagaaaaaggttgcatagaatgccaggggctcatggaccttgaaccaggcgatgcggaaggccatcatcacgtaggccaccgcgtgggccttggggaacaggtagccgatcttggccagggagtcgatgtaccactccggcacgtcgtggtcccgcatggcctccacccagccctcgtcaaagccgcccttcttcaccttgcccttgcggaccttctccatgatcttgaagctcatcttggggtccaggcccttggagatcaggtacagcatgatatcgtcccggcagcccaccgtctccagaacggaggcggtgccgctgacgatcagctcccgggcgttgcccagccacacgtctgtcccgtgggagaagccggagagccgtaccaacgtgttgaagtccttgggctgggtatccaccagcatctgccgggtgaatcgggtgttgaactccgggatcgccacggcgccggtggggcccagaatctcgtcgttctcgtatcccagcactttgctggaggtgaagatggacatggtgtccgggtcatccaggggaatctggcgggcgttgacaccggtcagatcctccatcatgcggaccatggtggggtcatcgtgtcccagcatgtccagcttcaggaggtttgcctccatagagtggtattcaaaatgagtggtgatggtgtcggagtcgtcggcgtccgccgggtgctggaccgggcagaagtcctccatgtccatatcgtcgggaacgaccaccaggccgccggggtgctgaccggtggtccggcgggtgcccacgcagcccagggtcaggcgattctcctctgcccggcccacagtcatgccgttctcctccaggtattttttcacgaagccgtaagcggtcttctccgccagtgtaccgatggtaccggcccggaacacctgggtctctccgaacatctcgatggcgtggcggtgggcccgggcctgatactcaccggagaagttcaggtcgatatccggcaccttgccgccgccgaagcccaggaaggtttcaaaggggatgtcgaagccgtctttgatgtattctgtgccgcacaccgggcagatcttgtccggcatgtccgcgccgcagccgtaggagccgtcctgaatgaactccgcatgcttgcaattcgggcagcggtagtggggcggaaggctgttcacctctgtgatcccggacatataggccaccagggacgagcctacggagcctcgggagcccaccaggtagccgttttccagggaccgctgcaccagcttctgggcggacatgtacaccacgtcgtacttgcccagaatgccgcccagctccacgttcagccggtccacaatcagcttgggcgggtcctcgccgtacagctcatggaccttgttccacaccagggaattcagctcctcctcggagttctccagccggggcgggaacagctcctccggcagcaaggggaaagtctccacctggtcggcgatggcctgggtattggtcaccaccacctcataggccttctccttccccaggtaagcgaactcctccagcatctcatcggtggtcttgaagtagatgggcagcggggcgttggcgtccgggaacttcttggaggccagcaggatgtggcggtacacctcgtcctccggctcccggaagtggacgtcgccggtggcgcagacaggcttgcccaactcctctcccagccggacgatggtgcggttgaactcccgcagctcctcctccgactggacgtcgccgtttcgcaacatgaaggcgttgttgcacaggggctggatctccagatagtcgtagaaagaggcgatgcgtttcagctcttcccagtccttgtggtccgccacggcccggaacagctcgcccgcctcacaggcggaacccacaatgatgccctcccggtgctccagcagcagactcttggggatggtgggcacccgcttgaaatacttcagattggaggcggagatcatctggtacaggtttttcagccccaccttgttccgggcgatcagaatgatgtgcttggggaagcggttggtcttgctgcccaggggccgcagcttctccatctcgcggtttaccgcctggagggtgtggatgccccgctcgtggagcatcttccagaaggggatcagcatatagcccacggtggcggcgtcgtcgctggcccggtggtggttgaagttgggcagctccagccggtccgccacgatgtccagcttgtactttcccagatccggcagcaggttctgtgccagaatcagggagtccacataggtgggctggaagtccagccccaccttccggcagcccgcccggatgaagccgatgtcaaactctgcgttgtgggccgccagggggcggccgtccacgaacttcaaaaattccgccagggcctccttcagttgaggggcgtccttcagcatgtcatcggtgatgccggtgaggccgatgatctccggcgtcagccgccggttggggttgacgaaggtctggaaccgatccgtaatctcaccgtttttcagcaccacggcgccgatctccgtaatggcctcccggtccaccttgaggcccgtggtctcgatgtcgaagcacacgaactccccgtccagggagcagtcctgagggccgtggaccaccacccggtcatcgatgttgttgacaaagtagccctccacgccatagaggatcttgatcttgtccccagcggcgtgccaagcgtccgggaaggactgggccacgccgtggtccgtgatggcgatggcgggatgtccccaccggatagcctgttggaccacctctttcgtgtccgtcagggcatccatattgctcatcttcgtgtggaggtgcagctccacacgcttctccggggcggtatcctgccgctcagtgtgctccgccagctggatgtggtaggggttcagctggatgtccttcccgtcccaggtgggctccatcttgccctggacgcacagccacatgccgggcttgatggcgctctccagtccctgagcctccttctccgtcaggttcttctgaacggtgacggagttggtatagtccgtcatgtcgaagctcagccgccacataccgggccgccgggtctcccggcactcgaaggcgaacaccttccccgccacggtggcattccccatcttcaggtccaggatcttcatgggcaccggctggatgcgaatgggcttgcccatcaggaccttgcctgcggcctgcttctcgcccttactgccggagggggccgccgggaccgaagcagccgggcggctccctgcggctgcggcctgggaagaaggagccttgcaggtgacttccgtcgtcacctgtcggaagccgtatacgcccatcagcagatgcttcagctcctccagctccgcatctcccagctccgccctggtggtgaggcgcagcgccagcgacatgccggcctggtcgatgcaagcgccgttcaccactgcgccggccaaacgaagccgcagctctccggagagctgcagctcagtaaacatttcaaaaaagggtatatctcttgacatagacgccaccttgttaaacaggaatcaaatgctgagaaatcagaaattaggaatgaggaattccggcgtccggcaacgccggacgtatgagcattgtcccaccagaggcggaacacaacaattccgaattcctaacttctcattcctcatgggagtttttcaatttcctccatcagcttgtccaccagctgctcctgcggtactttgtaaaggatttctcctttgcggaaaatcagtccctcacccttgccgccagcgatgccgatatctgccgccgctgcctcgccggggccgttgacggcacagcccatcaccgctacggtgatgttcttcgtgcagttcatgaggccccgctccacctcttccgccatggggatcaggtcgatgcgggtgcgaccacaggtggggcaggcgatcagattcacgccctccttacggagtccggcggccttcagaatcttcttggcagcgaaaatctcctcgatcgggtcggcggtcagcgtcacccggatggtatctccgatccccaggcacagcaggcccccaattcccatggcggatttcacaagccccatggaaggggtgcccgcctctgtcacgcccagatgcaaagggtagtctgtccgctcgctgagcagccggtaggccgccatggtcaggggcacatcggaacacttgacggagatgcagatgtcatcaaaatcgaacttgttcaaaagggccacgtggcccatggcgctctccaccaatgcctctgccgtgacgccgccgtatttggcccgcaggtccttttccagagatccgccgttgaccccaatgcggatggggatggatttttggcggcagatgtccgccaccgccttcaccttctcctccccgccaatgttgccgggattgatgcggatggcgtcgatgccccgctctgcgcacgccaaggcatacttgtagttgaagtggatatccgcgatcagggggatagaaatctgttccttgatccggtccaccgcctctgccgcggcctgatccggaatggcaatgcggatgatctcgcatccggcggcctccagcgcgtggatctgctccacagtggcgcggacatcgtcggtcttggtattgcacatggattgaatagacactggggcaccgccgcccacggccacatcccccaccatcaaacgctttgtcatggcgcttcctccctcaccagggcgtaaatgcaggaatccagcatctccccgtttttgtacacgctccgccgcagagtgccctccagggcgaaccccgccttctccaacacccggcgggaggccgcattcctggcaaatgcctcagcgtggatgcggacgatgtcccaggctgcaaagccctcccggcacatggtttccacagcggcggtcatgatcccgcggccccagaagggctctcccagccagtagcccagctctgcgctcctccggtatacatcgctgcccaggaacaggccgatgctgcccgcagcttcgccgtccacctcaatggcccggcacatctgaccccggccctcctgccggatgcagctctccacaaacgtggccgcatcctgtggggcataggggcagggaaacacgtcccgcaggttggcggcgatctttgcattgtccgcgtaccgggcgatggaggcagcatctgcctcccgccagggccgcagggtaaagtccgtcatgactcgctcctatccgaacagtttgaacacatcattgaatgtcaccaccagcatgaagcccatcagggccacaaagcccacggtgttcaccgccatctcatacttctccgggatcttctttcggaacagcttcatggcgatctcatcaatgatgaggaagaagatcttgccgccgtccagagccgggatgggcagcatgttcatcactgccaggttcaccgccagcatggcgccgaagtagaggatgttctccaccgcggcggcaatggtctctgacgcggtgcccacctgggtgatagtggagacgatgcccaccgggccgctgagatcgtccatgcccgcctgaccggtcaccagcatctgcaggctcagccgcacgatccgcacaaagtcgatggtgttcagccagctggtcttcaggatcgtccagagattggcctcctcaatctggtctcttgcgatatagacgccgtagccctgataggtctccccctctgtgccggtgtaggtgccccatgtgacgtcgttcagctccaccttctcgccgtcccgcaggaccaccaaatccatgggctggccctggtgcaggctcatcagcagggacacgtcactgtacaggtacacccgctccccattgacggaataaaaaatatctccggcctggatagtctggccgttccgctcctcaaactccggcgcggtcccggcggccgccgggatcagaaatccctgggcaccgctatacaccgccagaatgatgaggaaccccgccaggaaattcataaaggagccggcggcaaaaatcaccacctttttccagaagccctgacggcccagagaccgctcgtcgccagagtcctcatcctccccctccatagcgcagaagccgccgatgggcagcaaccggagggaatactgggtctcctccgtctccttgtgccagatcagaggccccatgccgatggaaaactcgttgacccgcacgccgcagagcttggcggccaggaagtggcccagctcgtggacggcgatcagtacgccgaaaatcagaatggccgccaggatatacacaatggtcatgcaaaaactcccgtcaaaaaacttgcttcaagcccggtccagcaccgcctgccgcgccgcctggtccgccgccagaatgtcctccagcgccggttcctgctccgccggcacagctgcccgggcctccgccaccaggcggggaatgtcgtggaagccgatcctgcccgccaggaacaggcccaccgcctcctcattggcgccgttcaaaacagcgcaggcggtgccgccctgagccgccgccgcctctgccagctgcagacatggaaatgcatcccggtccggctgggcgaaggtcaggggcgggcaggacagcaggtccagcggctccgccggactttccacccgttcggggtatgtcatggcatatcgaatgggcaggcgcatatccggtgtgcccagctgggccaggaccgccccgtcccggtactccaccagggagtggacgatgctctgccggtggatcaccaccgacacctggtccagcggcagacggtagaggcgcatggcctcgatgacctccagccccttgttcatcagcgtggcgcagtctacggtgatcttgggtcccatggtccagttggggtggcggagggcatccgctttggtcattttgcccacttcttcataggtcatgccgtaaaaaggcccgccggaacaggtcaggatcagccgccggatctcccggcggtcggcgcagccctgaaggcactggaagatggccgagtgctccgagtccacaggcacgatctcggcgccgtgcgtatccgccgcatccatcaccagctgtccggcgcagaccaacgtctccttgttggccagggcgatgcgctttctctcccggatggcggccagggtgggacgcagtcccaccatacccaccacggcggtgacgaccgtatccgcctccgggcagacagcggcctccagcagggcctccgggcctcccaaaaccttggtgtccatgtcggccaggcgtaccgccaggtcacgggccgccgcctcatcggtgaggaccgccagccggggccggaattttcggacctgcgcctccagccgctccacatccatgtgggcggtaagggcggccacacgcagtcccagctgctccgccacgtccaatgtctggcggccgatagaaccggtggcacctaaaattgaaatcgtcttgctcatagcattatcctattctaaacagctgaaaacaatcctaaatcttcccaaatcacccgttcagagcagctgtaaggccagccacacgaagggcgccacgaaggtaacagagtcaaaccggtccaggatgccgccatggcccggcagcaggttgccataatccttgacgccgaactcccgcttgatgacggagaaactcaggtcgccgatctggctgatggtgctgccgataatacccagtgcaaagactgccccccaggagatctgcggaccagctgccatctcgattggcggataaacagtcagggtgtgtgccatgctgtccgcgactagcttaaaaaccgtcatgccgatgacaccacccagcagaccgcctatggctccttccacagtctttttggggctgaccttgggggccagcttgtgcttgccgcacagcattccggcaaagagcgcgaaggtgtcgctgccaaaggagatggccaagggcagaaacacctgcagcatcccgatggcgggcatcatccgaagccgcagcagacaggagaacatcaaggggaacgccagcccggcgaagatagcgcaggtgacagcggcaaaggggatgccctgctcctcgtcataccggtggatagccagggcaaagatcgcaaagatgaacaccgcgcccaacagggcggcgaagggcagcaccggcagggcagtcagctccgtgttctcaatggacatttccccgtacacgcacaccggcaccgccgccgcggcgatcactgtcagggggtcaggggcttgcccctctctcccgccgccgcgcgcatcagctcccaggcgccgatggcgcacatggccgccagcaatagcatggtggcccaggacggggcccagcccaggatcagtatcaggagcggcaggcccactacggccaccatcacacgcttgaacataggatcagcccttttctcaatttctgtaaaggtttatttctttacgccgccgaaccggcggtctctctgttggtaggctgcaatggcccggtctagctccgcttcgtcgaagtccggccacagggtatccgtgtaatagaactccgaataggcgcactgccacagcaggaagttgctcaaccgctgctctccgctgggccggatgataagctccgggtccgggattcccgcagagtccagatagctggagaacagggcatcatccaactcctccggccgcctctttccggcggcgcagtcggtggcaaaacgccgggctgctcgcagaatctcgtctcgcccgccgtaattcaggcacacattggcctggaaatcgtccttggacaggtgctccgtgatctcgtccgtctcccgggccagggcccgcagatccggggcgataggggtcatgtcccgaagaagtggagccggatgtggtccttctccatggtgtccactgcctccagcagataccgcttcagcagggccatgatggcagagacctccacctctgaccgcttccagttttccgtggaaaaggcgtacaccgtcaggtactttacgccgatgttcttgcagtaggtagcgatgcggcggaacgtctccgctcctgccttgtggccagcggtgcggggcaggccccgcttcgtggcccagcggccgttgccgtccatgatgatcgcaatgtggcggggcgggaccaagggctggtccaccgcaccgttgatactctctggcatgataaattctctcatttcaaaatggattgttggggggatctgtcccattggacgggaaatgcagccatgatgatggctggcccattctctcccccattgtcgtcatcgcaaagtccgctaaacgcagtttccgcctgcggcaaaactgcgcccctcctctccccactgtgcaaaatacagcggagccggtgtgagacggtgcctgtgtatttacgggagaccgatgaaaatcgggggtgcaaaaccgcatttgaccagctgctctttccgcccgttccgctttacccgcaagcggtacgccgcgtctgtaaggcggcagaaccgccaaaaactgcgcagctgctgcgcactggccgagcgttgtggcaagaaacacaggtatttactggatagccagaaccgcacaccgggatgattaatatcttggtacagccgccaagcgggaaagcatcactgccacgcagagggcgctgacagcccagcagaggccgaaaaggcctatattcacagagttggaaatggaggcaatacccagagagagccccagccagttggcaaacagactgcgaatcaagaagaaaaatcccagcagcatggcaaccacgtgcccggcaaacagcccccggagatccttccgatgccgcagactccgccagcccaggaaaaactctatcgcgctgaccgcgatcacacctccgatgaacaggggaatcacttctgcttcaaacgacatttgtacctcctcctttttgtatcgggagaaatgtgtcggctgcttagttccccttttcccaccagcggtcgaacttccaaggaaagtggaagccgcaggcgcggcagtattgggtctcctccatggaaaaccagggcaggatgaagcgcccacagttgggacagcggagatggcgcagttcaatccccctaaaggcgattgccgcagcaactcccatggccaggaataccaaccccagtccgccccggatcccgcccgccagacacaaaagcaaaaccgctgcaaacagtgttcccctggctgccgaataccatttctgttccagtttcatagtcccctctccttcagtcaataacccccagattccacttccgcagctgccggtccaacagcagtgaacagaggaggacgccaatacgacgaccaccccgatgagatctgcaccatccgccacaggacggcagtcggggaatcgcagaaagccatggtgtgcccaaaggccagcccaaatcggcgcttgcactgatacaccggcgcctgtcagcgcggagagccgctgcaccggaacggttctgaagcgttttttctcttttaccggccccccgtggaagcggctccggcgggagcagaatccccccggccgccgggcggcggccccgagtgaccgcaggtcacctcacagaccctgaaagggtgacagcaccttacaaaatgtgcaatgcccccggcgggcagccgtgctcccgccggaggccccggcggcttttacaccgccatcagttccttttcctttttggccagcagcgcatccagctccttgcagctgtcgtccgtcagcttctggagatccttctccgcctgcttcagatcgtcctccgtgatctcggaggctttctccttcttcttgaacgcctccatggcgtcccggcggatgttgcggatggccaccttgccgttctccgcgtacttgtgaatctgcttcaccagttccttgcggcgctcctccgtcagctgggggaagctcagccggatgctggcgccgtcgttctgggggttgatacccagatcggagttctggatggccttttcaatgctcttcaccgccgtcttgtcccagggggaaatcagcagtgtccgggcgtcgggggaagagatggccgcaatctgctggatgggggtggggctgccgtagtagtccaccatgatccggtccagcacggaggcattggcccggcccgcccgcacggaggcaaagtccgcggccacggagtcgatgctcttcttcatcttgccctcataaatcttgtaatcttccttcagcataaataggtccttcctttcacagttgagtgtatggggaggcgctgtcgcgcatgcgtgctctcattccttgacgatggtgcccacgttctcaccgcacagggcccggatgatgttccgcgggtccttcagggcaaacagcagcaccggaatgtggttgtccatggacagggacgtggcggtggagtccatcaccgccaggtgctgggccagcacatcgtcataagtgatgacgtcgtacttcaccgcagtggggtcctttaccgggtcggccgtgtagacgccgtccacgttcttggccagcaaaatcacgtcggcgtcgatctccgccgcccgcagcaccgccgcagtgtccgtggagaagtagggattgccggtgcctgcgccgaagatcaccacccggcccttctccaggtgccgaatggcccgggaacggatgtagggctccgccacagcccgcatctcaatggcggtctgcacccggacgggaatccccttctgctcacacacgtccgccacagccaggcagttcatcaccgtggccagcattcccatgtggtcggcccgggtgcgctccatggcgccgccgctgtttttcgcaccgcgccagaagttgccgccgcccaccaccagacctacctggacgcccatgtccagacactccttgatgacatcgcagacctgaccaatcacctcaaaatccaggccggtatgcttgtcaccggccagggcctcgccgctgatcttcagcaggacccgtttatacacaggcttcgccatgatgaaaacctccgtctgttctgctcacaaaatatcattgatattttagcgtatttttccgcttttgcatagggggtagacaaagtttttccaaaaaagcaggtcctgcggacaggaagaagagaggaccgtggtcctctctttccgcattatcccccgcaggtctggaccagcaggcggatcaggtcctctttccccattcccttctccgcggaaaaggggagcagaatatccgcctccgtcagctccagcgtctcccggaccagttgaagggccggctccacctggctctttttcagcttatccagcttgttggccaccacgatctccggacagcccgtctggcggaaccagtcgtgcatcacaagatcgttggccgtgggcttgtggcggatgtccacgatcagcacgccggtggtgatccggtccgcctcctcctggaagtagctctccatcagcttcgcccaccgctccttctccgcctgggagaccctggcatagccgtaccccggcagatccaccagataggcccggcggtcaatgaggaagtagttcacctgagtggtcttgccgggggaggcgcccacataggcaaggttcttccgtcccaccagccggttgatgacagaactctttcccacattggaccggcctgcaaatgcgaactggggcagaccgtcccgaatgaaatcctcccgccgtccggcagagcggacaaactccgccttggcaaaattcaaagccatacaaacactcctttactgccgcacggcggcgtcacggccgctctcacgccccgccggggcaaaggccgccacatggtccgccacctcttcccggatgggatcccgctctgggcacagagcggcggcgaacacctggtccaccgtttccaccggcacgaaccgcagggcagcccggacggtctggtcgatctcctccagatcccggacgttgtccttgggaatcagcaccgtggtgatgccgctgcggagggcggccatggtcttctccttcaatccgccgatgggcagcacccggccccgcagcgtgacttcgccggtcatggcaatgcccgccttgatcttccggtccgtcagggccgagagcatggcagtggtgacggcgatgccggcggaggggccgtccttgggcactgcgccctctgggaagtggacgtggatgtccttcgtcttgtaaaagtccgctggaatccccagcaccgccgcccggctccgcaggcagctgagagccgcttgagcagactccttcatcacgtctcccaggttgccggtgagctccagcttgccggagccgtccatgacgttgacctccacctccaggatctcgccgcccgcctcagtccaggccaggccgttcaccacgccgatctcctcccggtccgtgtggagatcaggggatagggctggcagtccaggaacttggggagctcctcctctgtcacggtaatccgcttgacagtgccctccagcaggcgcatatccgccttccggcagatggcagccagccgccgctccagcaggcgcacaccggattcccgggtgtagtcccggatgacggcccggtacacgtcgtcgctgatgcggacagcgctcttcttcagtccgtgctctgccagctgcttggggaacaagtggcgcttggcgatctgcagcttctcctcatccgtgtagctggagagctggatcacctccatccggtccagcaggggccggggaatggtgtctgtggtgttggcggtggtgatgaacatgatcttggacaggtccaccgggatctccaggaaatggtcccggaaggtgctgttctgctcgctgtccaacacctccaacagtgcggaggccgggtcgccccggtagtcgttgcccaacttgtcgatctcgtccagcagcagaaggggattcatagacccgctgcggctgatggcctcgatgatccggccgggcatggagcctatgtaggtcttccgatgtccccggatgtccgcctcgtcccgaacgccgcccaggctcaggcgggccagcttccggttcagcgccttggccacgctgatggcaatggaggtcttgcccacgccgggcgggcccaccaggcagaggatctgccccttgacgtccggattcatctgccggacggcgatggtctccagaatccgctccttcaccttttccaggccgaagtggtccttttccagcaccctgcgggcggcgtccacactgacccgctcctttgtggtggtgttccacggcatctccagacacacgtccagatagttgcggatcaccgcaccctcggcggagccgaagggctgcttggccagcttgttcacttccttcagcaggtgctgctccgtctcctccggcagctccagggccaggatctcctggcggtaggattcaatctcgtcctcgtcgccgtcatcggtctcccccagctcgttctggaggacccggatctgggtgcggaggatctggtcccgctgggtgcggaccagctggtcccggaccttgctctccatttcgtgctcaaagcccagcacgttgttctcccgcaccaggaaaccgttgagcttccgcagccgggcgaagggggagaattcctccaggatctcctgcttgtcggtgtagcgcagggcgatgttctgggcaatatagtccgccaggaagccggggtcccggctgtccatcaccgtggccaccacctcctccggcacaccgctggcctgctcggcatactcgccgaacagggcgtaggtctggcggagcagggcctccgtccgggggctcttccgcatggcctcagaggacggctcctccgggatggcctccacattggcctggaggaagggctccgtctgccacaggcggcgcaggtgggcccgctgccgcccctccaccatcactcggacagaggactggcccagccgcaggatctgcgtgatgtgggagaccgtgccaatggtgtacaggtccttttcctccggcgcgttcaccccgatctcccgctgggtcaccaggaagatgtcctgatcggcctccatggcccgctccagggccgcgatggagatcggccgctccacgtcaaaggtcagtgtcatgtgtggaaacaccgtcaggccccggagggccagaacgggcagattccaagtggtcagttccatgtgcttgttcctttctgaggggatggtaaaacaggagagaggggcgcggcagcgtccctccctctcttcattaagacgccgacgcgggggtcgaggagccggaagccggcctgccctctcccttgccggtgttcaatttcacagaatagttgatcttcttggggtcgtgggtcagctcgggaccgctcctgccctccacacagtcctttgtgatgactgctttcaccacagcggggtcggaagggatgtcgtacatcatgggagtcaggataccctccatgacggcccgcaggccccgggcgccgatgttccgctcgatggccttgtcggcgatggcctccagggcctccggctggaactccagctccacctcgtcgtactccatcagcttcttgtactgcttcaccagggcgttcttgggctccgtcaggatgcggaccagatcctcccgcttcaacgcattcaaagacgcgatcaccggcaggcggcccaccaactccgggatgatgccgaatttcagcaggtcgtggggctggacctcgtgcaggatcttgctgatgtccttgtccttctttccctggacgttggcgccgaagccgatggacttctggtccagccgccgctcgataatcttctccagcccgtcgaaggcaccgccgcagatgaagagaatattcttcgtgttcacctggatgaactcctggtggggatgcttccggcctccctggggcggcacgttggcaacggtcccctccacgatcttcagcagagcctgttggacaccctcgccggatacgtcccgggtgatggaggtgttctcgctcttccgggcgatcttgtcgatctcatccacatagatgatgccgtgctccgcccgctccacgtcgaagtccgcggcctggagcagccgcagcaggatattctccacatcgtcgcccacatagccggcctccgtcaaggtggtggcgtccgcaatggcgaagggcaccttcagaatccgggccagcgtctgggcgaacagcgtcttgccggaaccggtgggccccagcagcaggatgttgctcttctgcagctccacatcctcgtccccgccgaagtagatccgtttgtagtggttgtacaccgccacggacagggccaccttggcctcgtcctggccgatgacgtactggtccagcacgtccttgatctcgcggggcgtgggcagctgatcaggcaggtcctccagcgcgctggaagaggtgtcctcaaacccatcgttcaaaatgctcatgcacagctggacgcactcatcacagatgcgcacaccgggtccctggatcatccggtggacctggctctcatgcttgccgcagaaggagcaccgcaggcccttcttgctctcgtcactcatggtattacctcagttttggaatttggtgcttatttcttgctggtgatgatcttgtcgatgaggccgaagtccaaagcctcctgggctgtcatccagtggtcccgctccgaggccgccttgatctcccctgccgtcttgccggtgttgttcgccaggatctcattcaagttcttcttgatccgcaggaagtgctccacgtcgatctccatgtctgtcaccttgcccttggtaccggcggagggctgatggatcatgatctccgcgttgggcagagcaatgcgcttgcccttggcgccggaggacagcagaaacgcgcccatgctggcggccatgccgatgcagatggtggatacgtcgcacttcacgtactgcatggtgtcgtagatggccatgccgtcagtgacggagccgccggggctgttgatatacagctggatgtccttgtcggggtcttgggcctccagatacagcagctgggcaaccacaaggctggcggtggtggcgttgacctcttcccccagaaagacgatccggtcgttcagcagacgggagaagatatcataggaccgttcgccgcgattggtctgctcgactacataagggactaagctcattggtaaaacctccttgatttccgcaccggggaccggcacagatgacagatctgttcctcccaaacccgatgcgtcttccccgccccggtggggcaggtaaggcaaaagcgcccggcccgcctgcgggccgccgcgcctctgccaacgcacacgcctatcttaatatagacgccatgcgggaatctgtcaaatcgatgtagagcgccttccgccggcggaaaaacacaccgctccgccggggccgtcaattcctagtatacccggaattatttggattcagcaggcgtctcctcttctttttttgccgcagccttcttggtggccttcttggcaggcttcttctcctcgccgtcctcgtccgccttcttgcgggtggtcttcttggcaggcttttcctcagcggcctcctcaccctcggcgtcctctgccttcttggcagtcttcttggcgggcttcttctccgccttcacggcggtggcgctgtccaccaccacggcgatggccttctggctcttcagctggtcctttacctgctcagcctggagatacttcttcacggtctccagatccatgccgtactggtcggccatccgctggaactcggcctccacctcttcatcggtggcgtcgatgttctcctccttgatgatggcggccatggccagatccatgcggacctgcttgagagcgggctccttggcgtcggccagcagctgggcctcatccatgccggtggccttcatgtactggtcgtactggagaccctgctgggccagctgcatcttgaagttgtccaggaactggcgggactgggcctccaccatggcgtcgggcacatcggcggtgatgttctcagccacctgctccatcagggcgtcctcgaaggcgcgcttcacggtctcctcccgctcggcggtgatcttcttcttcagatcagccttcaggtccttcagagtgtcgaactcgctgacgtccttggcgaactcatcgtccagggcggggatctccttctccttcacctcatggaccttcaccttgaacaccactgccttgccggccaggtccttgtgatagtcctccgggaatgtgatgtccaggtccttctcatcgccggccttcacgccgacaagctgctcctcaaagccgggcacaaaggtgtgggaacccagctccaggctgaaattctcgcccttgccgccctcaaaaggcttgccctccaggaagccctcgaagtcgatgacgaccgtgtcgccctccttggcctcccggtccacgctcaccagacgggtgttgcggtcggtcagagccttcaggcgctcgtccacatccgcaacggagaccttgacctcctccttgggggcggacagtcccttgtactggcccagggtcacttcgggatacacaggggcggtggccttgaaggtgaagccgtcgcgggtcacctggccctcgatctccacagagggatagcccaccacctggagctcctgctccttcacggcagcctcataggcctcggggaacgcgatattgattgcctcttcgaaaaacacctctgcgccgtacatcccctcgatgatcttccgggggccttgccagggcggaagcccggcacgttgatcttcttgcgcatcttctgatatgccttttcgatggcagcttcaaactccggtgcaccgacctcgatggtcagaacgacctggctcttttcgatcttttcgcagcttttcacactcatcttgtttattcctccgttcatcgccggtcataagccggtgcgaaatggtattttaccatacaaaacctgaaaatgctatacttttttccgttattcacaaattttttttggaacaaatcccagatagtcggcggagatcagggagaagtccgtcccattccacccgccctccagccgccgtttgatggcgtagccgtggaggtggccgtagcagcaccgctccacggggtaggccgagagcagccgcaggatctccgggcactcgtagccctgatacagcggcggatagtgaaggaagcagaagatggaccgtccctccgccgccttcagggaagtctccagtcttcccacctcccggttgaggaccttggcgttgtggggcttctggtcctcctcaaagaaccatccccgggtcccgcacagggcgtagtctccatacagggcgcagttgttatggagaaagtccagggtggtaaggcccttctccgtgaagaagttcttcattttggacaccgtggaccaccagtagtcgtggttccccttcaccagatactttttgcaggggaactggtccagaaagcggaagtccgcctccgcctcattcaggtcgatgccccaggaggtgtcccccgccaggaccagcacatcgccggcggtcagccggctcaaagcatcgccgatgcgctccgtgtaattctcccaggcggggccgaacacctccataggcttgtccgctgtcagggagaggtgcaggtccccgatggcgtagagggccatgcggcacccctcctttctctgtgtcccgtgaggcggagtcagccgtcctcttcggcggctccaactccccggaactctgttgatctatcttgatctgtgtccatctcgattttcacgctgctgacctttccccaaacgcgtccgcccaccttccggacgcctgtcttggtcagcagaatgccgggcagcttgctgccctccgggagccagagggaccctttgtagccttcgccccggatccgcccggcgccaattcgccgccgcaatagggacagcgccgctcctgtgctatggtgctctactcccctttgcgtttttcggttgggtcctccgggtcatcaaagacaatttccctgccgcacctgtcacagaagtgcttttcccccttccgccaccatggcatggcatacccacggccgcagtatgggcagcggaggtttcggacccactggatgcctccgttgaccagcagcacgattcctgtgatccgcagggtgtttttgatccaataggccgtgtccatcacccggtaccggtctcccagggtccggtagggaatcagctcgttgacagccaggaagaaaattcccaaagcaaagaacagcagcaccaatcgggcaaatgcccggctcaaaggcttcacgcaatagcctccctgccctctttcgggtttccaaaatccaaaggcaacagatttacagtctgccgcattaagccgtttcccgcgttgctttgttgcagcgcgatttacttcaaaaactccagcaccacgctgtccataccgggcttctcacaggtgaggtcgaaccgccgggccttgcccttcagggccgccaggcgccggggaatcgccgtgccggtggtttcatgcagctggtccagcagctccacgccgtcgcccgccggggtctccccgatggcccgcagcacgtggtcgcagaacttgtagggggaggcggtggagacgaacaccgtcaccgtcttgtcgccggtggccttgcggtactgttccatgacgctggcggccacggcggtgtgggtatcgatcagatacccgttctccttgtaatacttggcgatggcagcggaggtgcccgcctcgccgcagaagccgccccagaactggtccgccagagccgccttgatggcgtcggacacttcgtacttgccggtcttggcgagggcatccatgtagcccttcacctccgcatcgttttcgccggagaggtcgaacagcagccgctccaggttgctggacaccagaatgtccatagagggactcatggtggtatggaacggacggttcttgtcgtacacgccggtgcggaggaagtccgtcagcacatcgttgcagttggaggcgcagatcagcttcccaaccggcagtcccatgcgctttgcgtagtaggccgccaggatgtcgccgaagttgccggtgggcacacagaagttcaccttgtcgcccatgctgagcttcccgtcccggaccaggtcgcagtaggcggagatatagtagaccacctggggcaggatacggccccagttgatggagttggcggaggacaggaagtaaccccggtccgccagggtggcccggatggcctcatcggagaaaatgcgctttacaccggcctgggcgtcgtcgaagttgccctccacggcgcagacgcccacattggcgccgtcctgagtgaccatctgggtctcctggaccttggacacgccgtccttggggtagaatactaggatcttcgtctgcggcacgtcggcaaagccctccatcgcagccttgccggtgtcgccggaagtagccaccaggatgcataccgtcttggactctccggtcttgcggagggcggcggagagcagctggggcagcatctgcagggccatgtccttgaaggcgctggtggggccgtgccacagctccaggcagtgggtggtctcgtccaccgtgcggacaggggccacggcgtcgcagtcgaacttctcagggccgtaggcgttctccgcaaatccggacagctcctcataggtgtagtcggtcaggtacaggcccatgaccttggcagcccgctcctggtaccggacattcaccaggctctccaaaaaagcccggtcgatctgcgggatcccgcagggggtcagcaggccgccgtcccggctcaggcccatcttgatggcctccgctgcgtccatgcggacggcggcgtcccgtgtgctgtaatacttcatgtcgctctctccttctgactgtttttcaaaacgcattttccaaatattccagccggagggggcggtgaaccccatccgtataaacctccgccacatcgaaccgggcgggagcgtccaggtcgtgctgactgagatagcaggccgctgcggcccggagccgttcctgcttccgccggtccaccgcctcccgcggcaggcccgcgaagctgccgctgcggagctttacttccacaaagcagatggtgccgtctctgtcccgggccaccagatccagctctccgtaccggcagcgccattggcttgccagcaactggcagcccctcttccgcaggtactgtgccgctgcggcctcgccccggtcccccagggccttggtggtattcatgtgcgccgggcctcccacttcttcagaaaagtccgccggtgggcagggcagggaccgtaccgatccagcatttcatagtggagcttcgtcccatagcccttgtgtttggcaaactggtactggggatactcccggtccagcacgccggtcacataccggtcccggctgaccttggccaggatggaggccgccgcaatggaggcactcttcccgtccccgcctaccaggcacatgtggggcgccgtgatggagacgctgctgccatggtcccggttgccgtcaatgaggcacaggtccggccgaatggataacccctcaatggcccggttcatagccagcatccgggcgttgaggatatccaaactgtcgatctcctccgccgtcacaaaggcgatgctgtacgcctctgccgtggcggtgatctggtcgaacaggacatcccgcttcttcgtcgtcagctttttggagtcgttgaggccaggaaaaccgatctcccggggcagaatgacggcagcggcgtacaccggccccgccaggggcccggctcctgcctcgtccactccgcagagggccgtgagaccactattccattgttcacgctcataggtccagaggtccatttccatcctaccaatactccatgacgatcttcttgcaggtgcgacagacccaggcgggaagccatgtccggttgtagcggaacgtcatcggtccgtccagcacaatgccgccatctgcctcgatgttccgcctcgtataaaacgtgcggaggtctttctctcccggcatgaaaaaaagaccgatgctgttcttggtgatgacatggcccttttccatctcttttccgcagacagggcagttcatggatatgcctccctcctcgcagggcaggttccttcgctttccgcgattcccgccaagtgatgtcaatactccagaaggatctttttgcaggcgcggcagacatagccatgtacagttgcgcggtcgctcccccgtatatgatgcgggccatccaaaacaatcccgccgtactgttccacactgcgcttcgtatcccagaatcccacttttccgccgggcggcaggaagaaaaggccccgccccagctccgtataaaggctcccccgctccatctcttttccgcaagacgggcaattcataggcgcgcttccctcattctgacgctgcaggctgttccgtctcctccggcatttccagtgtgaagcgtcccagcttgccagctctatactcgtccaacagaatcttggccatccgctccgtgtccacctcgccgccggagatcagaaagccccgctttttcccggcggcctccagcaggcggtagccccaggccacgtcctcctcgccgtcctgacgctccggcagggacgggagcttgtagccggtcctcagggcctccggatagttggtgcccaggtacgccatcaggtggcagcccagggtctccatgtccaggatctcgtccttcaccgcgccggtgtaggccaggttcagccccacgctctggtcctcaaacttgggccacagaatgccgggggtatccagcagttccagcccgcggtcgatgggcacccactgcttggcccgggtgacaccgggccggtcctcggttttggcagtcttgcggccggcgatcctgttgataaaggtggacttgcccacgttgggcacgcccaaaatcatcacccggaccacccggttctgccccttttccgcataggcgcgcagcttgtccgcaagaagcgtcttgacagcagcggcaaactgctttgtcccggcgccgctcttggcgtcggactccatcaccgcgtacccctttgcccggaaccaggccgcccaccgcttcgtggcgtccgggtccgcctggtccacccggttcagcaccaccagccggggcttccccgccgtcagttcgtccacatccgggttccggctggacacaggaatccgggcgtccacgatttcgcacactgcatccacatgtttgatctgctcggcgatcatccgccgggttttggtcatgtgaccgggataccattgaatattcatagtcctacctcacgccgccccggcgggcggcgcccaatcaattcttctcaggaagctgtccccgtggctcagtcgatccccgcaatggggccgatgcggccgaagtcccgctgcccggtggcctcgtccgcgccgggaaacagcaggaacaccgccttgccgatgacataccgggtgtccaccgtgccaaggtcgctgctgcggctgtcgctggagtggtttcggttgtcgcccatgacgaaaatggagccctccggcaccgttaggggaaattccgtcccctcctccacataggtgggctcgttgatatagtcctcctccagcagctccccgtccacatagacggcgccggagacaaagtcgatgtccaccgtctggccctccgtggcgatcacccgcttcacgatgggctcctccagaaaggtgtccttccgcagcaccacgatgtcgccgtactcatagtcgttgtccagcatggcgttcagcaccagcagccggtctccgtcctgcagggtgggcaccatagagtggccatccacgccgatgagccggatgacgaaggtaaacagcagcaccaccgccagcacggagcacaccagcgcctgggcccactcatacaggtcccggccctcctccttttccggagacacctcctgcgtctcctgcttcttctctttcttccacatgtctgcaaaacctccgcgggcgctttcgcccctgttgatggaaagccccccgccggaggtctccttgctcttatgtcagcgggccgatcctgccgaagtcccgcttgtcggtgtccgcagtcacgcctgggaacaacaggaacaccgcccggcccaaaatctgccgggtatccaccggccccagctccggatcccggctgtcatcgctgtcgttgcggttgtcgcccataacaaagacgcagccctccggcacggtgacagggaactccagcccctcctccagataggtgggctggcggatgtagtcctcctccagcagctgcccatccacatagacggcaccagcggtaaagtcgatgtccaccgtctggccctctgtggcgatcacccgcttcacgatgggctccccgtccttgaagctctccttccggatgatgacgatgtccccggcctcaaatccaccgcacaggtgggcgttcatcaccagcaggcagtcctgatgctggagcgtctcccgcatggaggggccggacaccagcaccacccgcgccgcaaaggtgaacagcagcaccgttgctgtcacggcgcacaccagcacctgcacccactcgtacagcccgcggagggaaagcgcgtccctgttgagccgttttcctccccgcacgtgaccgcctcctccagcaccgcagtttttcacaataacgtatgctagtatatcaaagaaccgtcaaaatcacaagatgccggggaaattttgtgtgacaagaaaaaagagaggctttcgcctctctttcgtcttggatcacagcttttccttgaccttggcgcccttgcccacgcggccgcgcagatagtacagcttggcacgccgcacagcaccgttgcggaccacctcgatcttgtcgatggagggagagtgcacggggaagaccttctccacaccgacaccgtaggagatgcggcgcacggtgatggtctcggtgatgccgccgtgcttcttggcgatgacggtgccctcgaagacctggatacgctcacgggagccttccttgaccttcacgtgcacccggaccgtgtcgcccaccttgacgggggtcacttccgcttccagacgctctttgttcagttccttaatcagatccatggatgttcctcctaaataataggtgttcatgccgcttctctcaaaggcacatcaacgcactccggcgtgtgcacggcagaggaccaccctttgtagccgtaataggataccacggccaggaggaaaatgcaagtattttttacaaaaaatccgcctttctgccgtgcagttcccgaagagccgccgccagcaggccgaatgcagccggcagcagccacaggctcccgccggtccgcccgatcagccacagtaccaggccgcccagggccagcgccgtcgtgccccccgcccagcaggcgatgcgctccgcggcggagggacccgccagccatgcggccgcgagatacagcgcccggccgccgtccaggggccgcaccggcagcaggttgaagaggcacagtgacagatgggctcccgccgccacccaggcgtgggcgccccccagaaccagcgcgcacagcagattcactgctggccccgccagcaccgccgcgatctcccccggataggacaggcgggcggcggaagtcatcagctccgccccaaagacgctgacccgcagctcccgcacccgggcccccagcagccgcagcaccagcaggtgtcccagctcgtggagcgccgcggcggagaggatcaccgccagcagctgccagccgttcaccagtgtgaaccaggccgccagcagccagaagccgccggaaatccgaatccggtcacgccagcgagacatagtagatgggatttaggtactggctgccctcatggagctcgaagtgcagatgaggcccggtggccacgccggtctcccccacctctgcgatcacgtccccctccttcacagaggcgcctgaggaggcgataatccggctgcaatgggcatacagggtggagtagcccccctcgtgggcaacggtgatgtacttgccgtagctgctgctctcccccacggcggtgacggtaccgtcggcaaagcagccgatctccgtcccagcggcggcgccgatgtcaataccatagtggaaccgctcctctccctccaccgggtgctcccggtagccgaaatcagaggtgagggtgcccatcaccggggtgcagtaatcaaagcccagcagggcctgttccaggcacacgttgtccggcaggttctggtcggagtagaggacgtaggccagggtagacgcctccgccgcgccctgggatgcggtttccgcagtctccgctgtctgatcggcctctgctgtctgcgcggtctctgccgtctgggatgctgctgcgggcagatccagccagccgtcgctgctgccggtcccggtccggaaggcccgcaggggcgcgatggccgcaggaagctggagagacaccgcctctccccctgccggggctgacacctccacggcggaatcctcctgagggtcgaacaccgcctgatacatatcctgaagggccacgtccacatccgcttcgccgctcacggcccgccccacagcggagaacacggcctgcacatcgatgttctgttccagcattccggtgagcttggcattcacctgggccatgcgtcccggcagcaggagcttcaccgccaccagcagcacaaagatgctgccgcaggccaccagctggatcagatgccgccgctctcccggagtcagagtttcccgttttccccgctggaccctgtgcggcgcagccggggtactccgccgccgcctttccgccgcccgatgctgggacgagacggtgccgatccgccgcccaacgtgccgtgccgccatgacgctccctcccctgtcggaatctattccaaactctatgcgccgaccgggcgggatatgcgtctttgggaatcgtctgcccccgccgaaaaagagaccgggaaggggctcccttcccagtctcttgcacttgcccgctttgcggggcgttatcccagcaggcccagcatcgccgcacacagggccgtcctgtcccggatggaggggatgcgcacccgctcttccgtggtgtggatctgttctgcgatggcggagagggcgtccaccgtggggacgccgtaagtggagagataggccccgtcggtggcggcggggtccgcgatctcctccggctcccaacccagcagctccgccgcctctgccgcccggagataggcgctgtgattggcggcgttccgctccatggcggggaacagcgtccggtaggtgacctgcacccggcagccctccaccgtcacttggtccgccatgctgtccagcctggcctggatcaccgggaagtccgcgttttccggaatcccggccacgcagaactccccccgggcctctccggccaccacgccgttgggccgtccgccggagatgggcgccacattgtagtagatgcccttctcatagtcgttgaagctgtatagccggatgatctggtgagccagctccagcacggcgctgcggccctccagatacgccttgcccgcatgggcctcccgccccgccacgtcgacggttcccagaatcaccccccggcgggatgtgacgaaccggggacgtccgtcccgctcccggccgccctcgaacaccagggccagagccgcgtcctgcgcctcccgggcgtagaccttgcggccggaccgggagccggtctcctcgtcacaggtgaaaaggtacgtcagctcccaggggggcagcaggcccgcctttttcaaaatcagcgccccgaacagggagataaggacgccgctcttgcagtccccggcccccaggccgtgggcccactccccttcaatatgaaagtggtgcttttccgcaaagccggggccgaacaccgtgtccaggtgggcggccagcagcacctttccccggggctgttccggccgcacccgggccaccagatgggtccccagaccaggctccgtcacccgctctgtccgggcccccagctcggagagcaccggctccagcagcccggtcacggcggcgttgcccgcctcattgccggtgccgctgtcgatggcgcagatctgttccagcagcgccagctggcggggcagcatctcctccgccccggcccggacgatccgggccagtgtctgtctcttggcatcctccatcggccgtgcctcactccgccagcaggtccaccatgacctccgccggatcgaaggcggcgtcgatcatgcccaccttctggagccagtcgatgttctcctgccacacggacacgtcctgggacaggaagggcgcgtcggccgtctccatgatgggcagcagcacatcaaagcttcgccgttccacggactccgtcaaggggaagttctcctcgtcctggttggccaacaggagccccaacgcctcctccgggtccgcctgcatatcggcaaagcccttctgacaggcccgcaggaaccgagtgtacttgtcccggttggcctccagctggtcctcgccggtcaccagcatcagcgcgtagtagttgggtacgccgtagtccatgacctccatgtagtccacggcgaagccctcctcctccagcgcaggaacctcgtggttgatgaagcagccgaaggtggcgtccacatttccggtggtcatggcgctcatcaggtcaaagcccacgtcgatcaactccacgtcatccagcgtggcgcccacagtctccaacatctggcccaccgccacctcgccgaagcgggtgccggagtagccgatggtcttgccgatcaggtcctccggggtcttgatgtttttctccgccagggcacagacgatgctgatgggctgctggaccacagctcccagcaccttcaccggcacgtcctcattggccttggcgatgatggtgtcctcctgatagtagaagccgatatccgcccggcccgccgccgtcatggtcaggggatcgctggcgttagaggggaacaagatattcacctgcaggccctcctccgcaaagtagcccttctcctccgcctcgtagaggaaagcatggacggcgttgggataccagtccagcaccacgtcgatggtctccagctctccatcgtcctgcccgtccgccgtgtccccgcttccgccggaggagcagccggtgagcagcagaagcgccgtcagcaacagcgcaagtttctgtttcatcatcaatcttcctttctttataaactggatccaggtgattcctgcggggcccgccccgcaggtttcaggactctcccctccagcggacgaaccgcttttccagcaggttcacaacggccaccgccaggatggccgccgcggacagcagcacaataggggcgaacaccccggcgccgtccaactgggtcatcatgcggcgggagaagtagcccaggccgctcttggcccccaaccactcgccgatggccgcgccgatgatgctcatgggcaccgccatcttgacggcggagaagaagtatggcagggcgcagggcaccttgatcttcaaaaagatgtccttcttcgtggcaccgtaagtctccagcagctccgccatctccgtcttggcggagcggagcccgtcgtacactgtgatggtgatggggaaaaaggtgatgagcactgtcaccagcaccttgctccagatgccgtagccgaaccacagcacaaagagcggtgcgatggcggtggtgggaatggtctgggacaccaccacgatgggatagatcatcttgcggaccaggtcgctctcgtccatcaccaccgccagggccaggcccagcaccagagagatccccaggccgatggccgtcaccagcatggtggcgggcagatgaacagtgaagaggacatcccgcagctcccacagcttcgccaggatctgggtgggagacggcaggatataggccgcgtctaatcccatggcccccgcctgccagagaatcaacagggcgaagagaaaaatcatggcaggtagatttgctttacaggtctttttcatggggtcacctgctttcgcagaaggtcgatgagatgctccttcagctccaccatctccggcagtttgaggcaggagcggtcccgcgggaaggacgcggggaccggaatctccgccagctcccggatgggggtgcgctccaccaccagcacgctggaggagaggaacagcgcctcctccacgtcgtgggtgatgaagaggatggtcctcttgtgccgctgccactggtccagcagccactcctgcatggagatccgggtgaggaagtccagggcggagaagggctcgtccagcagcagcaggtcgcagcccgtcagcatggtgcgggcaaaggccgcccgctgccgcatcccgccagagagctcgtccggcatcttgctgccgcagccggcaagtcccacgtcggccagcgccgcctccgcccggtcccggcgctccgcacgggtcagctccccctggatctccaagggcagcgccacattttctcccacggttcgccaggggaacagcaggtccttctggggcatatagccgcagtagtgcttgcgtcccacaatggacttcccctccaccagaatggtccccgccttgggctttagcagtccgttggtcatgcggaagatggtgctctttccgcagccgctgatgccgatgatgcagtggaaggagccgggttccacggcaaagctcaggtggtcgatgatatcgaagtcctcgctggggtactgataggagacgttctgaaattccagcatggtcatcgctccagcgtccaggccatctcccagaagcccagctcataccggctgcagttgacgaagatctcctccagccgctggtattccgcctccgtgcagctctccgccagggtgtccatcagctccaccagtgcgtcgttggttttctggtagtcctcccccgcgtagctgcggatccactcgccgtagaaggggtggtccgccgcgccggggatggccgccaagcgcgtgccgatctccgcatagctccaggagcaggagaggatggcggcgatgatctccgccggcccgcccgcggcggcacaggagagcatgtagtgggtataggacaaattggagagggccggctggacagaaaacacctgctcctccgtgatgcccaaccgagccatgtaggcccggtggaccttcatctccccgcccagaatcgcgtccacattggcggagaaggtccgcatcaggccggggtcccgggccttcactacaccgtaggcgaacacccgggcgtagtcgaacaggtacagatagtcctgcagcaggaaccaccggaacttctccaggtccaggctgccgtctccaatcccccggacaaagggatggtcatggcactgctcccagatgggatgggcggcctcgtacagccgctgtgtcgttctcattcgtattcctcctatccaatggccggtccgcccccatgcaaaaaggcggggtcccctttgggacaccccgccttcgctccaatcctatctcttccgtgcggaagagactccgcacgaatagcttgtgctgcgtccctacgttggcattacccacatcaggtcaggtcgagggaccggcccctcatctcagcctcctcgcggaagctcccttgcacgttttattataaaagcccgtcttctttttgtcaataaatttttcccggttttcggtaaaaatcccgcatttacaccagatgccgctcgatctcctgccgggtgggcagggaggggatcgcccctctgccctgaacacagagccatccgctgacgttgccgtactccagcgcctcctgcaccagcggctccgtcagctgctccgcctgggtgacaccccggaatcgcatctgagacagcattccgccccagaaggcgtctccggcgccggttgcatccgcgcagtgggcccgccgacccgggacagcgaggcgccgcccccggaaatatcctctggcaccctgaccgcccagggtcagcaccaccagcgtcaatccgtaccgctccataagggcgggcagctccgcctcgccccccagcatatcggcctcctcctctgagatcttcagcagatccacgtccggcaggatctcccgcacctttgcggcgcaggcctcctgactgccgttccacatcatgtcccggtaattcacatcaaagctcaccagcctgcccatctcccgacccaggtgcagggccttggctgtggcctctgccgctggggaggcggagagagaacacgacccggcgtggacgatcaccgtgtcccggatgtccgcctcccgtacgtcctcctcccgaaggaacatatccgctccaggcttgcggacaaaggtgaagctccgctccccttcctccgtcaaagagacaaacgccatggtggtgaccgcctcccggcagggctcccgccggatacagcgcaccctgttttcccggagggtgcccagcaggtaccgcccgaagtcgtcatcccccacagagcagcacatggccgcctccaacccgttccgggcggcggcgatggccacatttgcaggggcgcccccggcgtttcgaatatagcttccgggctcactgcccggcaaaaagtcaactagcatctcgccaacgctgtaaaggtccaccagtggtcctccttgtctgaggtggttttgcaatcattcgcatcgattattaaaccatttccagcgttcaatgtcaatcgtttagctgatgtttttataggagaaaaatgtactttttgtgggatttccgatattgcggcaagccgccccgggaaatcacccgttttgaagaggtagctcccccgagaagatccgggcgatcccgccgcaggccgcccccagaagcgctccctcccccaggaagcgcggctttctcaccaggactctgccgcccccatccgctgggcgcaggcgggcaatggcggattccagatccgccacgtgccggtcggtccagcagagtccgtcgccgcccagcaacaccagttcgctgttcagcagattcagggcgctggcgatccctgcagccagaaagtccacggtctcccggaacacccggtctacttccccgctgccggttatccggcagaaatcggcgtaggaagcctccagtcccgttcgatgatacagttttttcagcacctccggcgaacgaacgtacagctccaggcagccacggccgccgcaccggcagggacggccaccggcgcagatggtgacatggcccagccccaggggccgtcctccccggcccctgcacagttgcccgccgctgaggaccgcgctgcccacccggtcccccaggctgacaaacagcacgtcccggcagttccgggccctgccgaacaggctctccaccagcagagcgctctggcaggtgtcctccaggaataccgggaggccgtaccgctcccggactgccggacgcacggattccgagggacacatctgctccccgccgggccgccagggcaggtccgccgccaagccgatggcccgtacaccagccgtcccggacagcatcttgtccaacagcctgagagcggtctcccgccgcaccgcctccggagcgtccttcggcaggtccgtgccagcccgccggaatacccggaggtccagcccgcacagaacactctcacaacggcccgggaggaacgccacgcccgctgccttcggcgcttcgggtgagagccggaggcgcacggggttccgccccggctcctcgctgcacaccacctcgctctctcgcaggacatccccgtcgatcatctcacccacgatattggagatggtcattttgctcaagcccgttctcaccaccagatcccgccgggtccggcatgcgccggtggcaaccatgcgcaggaccaatccgcggttgtcccgcctgttgtctccgctgttttttcccgctttctccagcatgacctgtcctttcccgcgatgcctgtcaaacctcccgtgccggagttcgcctccggcattcttcatttgtttactatatgacgctcccagaggcccgtcaagaaaaaccgctcccccacccggaggagcggtataggacatcatctaaattctgtcccatatcaccgtcccagcagggcagccccgcccagcagcaccccatagactatcggctggtggagcatatataccggcagggactgcctgcccaaggcacacaggggcggacaccggagcgcgtccggatccagccgctccatcggcccggccagcaggcggcggagaaaatgccccgccaggaacaggaacagccagggcagcagggagaaataatccgtggagaaaaagtccggcggcggaaatcctatgtacgccgtcagcagattacggtaaagtccctccggtaccgttcccagcgtccagtcctcaaatcccagcgtcccctggttcacgttccgcagcagggtgaacaaggccgcgctggcggcgaggcccacccccacaggtacgtgccgcagcagtttttccagtgggaccatcagcaacatgcaggagccgatcagcgtcagcacgccgaaccagatctgctcctccggcatgaagagcaccgtcaccagcgtcaccacccagccgcagccgaacaccgtcagtcccctccggaggggccgccgccccaggctgaagcaaaatccggagaggaggataaaggtccagcagatgctctgctgccagatgtacgcgccggtgccccggtaccaatcccagtccgcgtggaacagatacaccaagtcccagcaggcgtgataggcgatcatgctcaccagcgtcaggccccgcagggcatccagggaggcgatccgccttctgggccggaccagtgtccgagtcccgctgtctgctgccatcttccgctcctcctctccggcgaccggcggaaccggtcgtctatctcactccggggtcagccccggtgctcccgccggtactccgtggggagctgtcccgtcacatccttgaatgcccgggtgaatttcccctggctctcgtagcccacggcggccgcgatggcggcgatgctcccgccgctctcccgcagcagctccatggccctgcgcacccggtactctttcatataggtggcgatgggcaggccgtacaccgccttgaacacctccttcaaggtggaggtgttcagcagatacctgtgggagagctcctcaatggtgtaccgccggtccaggtgctcggtcagcaatgcgtggatctcctggatacgcgccgtctgctgggagccgtaccgggtcagctcccgcccgccggactccagcccctccaaatacagcagcagctcctggagcttcagccggagatagggcagccgccgcatctccggctgccggtacaggggccggaagatctcctccagctccggtcccgccggaagggcgaaggtcccgcctccgcagaatttttccgccagcctctcggcctggaagtccgcctccgccaagatggggggcggcgactccgccagatgggtcaaatctacgcagatcatcagccccgcgtacatctccgccgggaagtgcatcacagaatccgcgcagcagtccgcactgtggagggacagatcgccctcccccagatagaccgacatgccgtcccgcaggtcccagcccacccggcccaggcggcagtggttgatctccagcgtggaccgggccgcctcgtgccggaaggcggcataggtgcccaggaccgtgttgaaggacgcctccacccccggaaagaccgggtagacctccatccgtccccgtccatccgtctctccctgaaatgtcccggtgaacaaaaccccaggttcggccgcagggcgccccacgatctccatagtcccctgcggcagctccgccagagccatccgcaggcaatccgcttgcttcattccgccgctccttcccacctcacgccgaggggcaggcaatctccaccatcgcctcaatcatgtggtgcagcagctgggcccgctccgtctcggcagccttatagtagacctctttcccgtcccgccggctgacgatcaggccgccggccttcagctgcttcaggtggtgggacaccgccggggagctcatctccaccatggaggagaggttgatgacgcactcttcacagtggcacagcagccaaaaaatccggatgcggctgccgtcccccagctgtttgaagatgtcagccactgtctggaaatcgtccacgctgggcatctgttccagctcccgctccatggactgtccatggtcgtggggcagcttcttttcttccatcggtcgtccctccttctggttttgtattctaccacaccccgcgccattctggaagagcgaaaatatgccgccccgcattggcccaatcggaaggagtttttgcccaatcggaagattctctccctcccccgttgacttggggggccgccccgtgtatgataagaccatagattaaataattgcttaatcgttttgctcaattgctgaagggagacttttatatgaaaaaaacctataagatcgatgtggactgcgccaattgcgccaacaagatggaggaggccgcccggaagaccgaaggcgtccagagcgccaccgtgaacttcatggcgctgaagatgatcgtggaattcgcggaggggcaggaccccaaggccgtgatggagcaggtccgcagaaattgcaaaaaggtggaggacgactgcgaaatctacctgtaagcgcgtttttcaggaaagcaccccctccggaggcggggtgttttctttcccaaaacaattaaacgtttattgaattatcagccgcacggagcggctcagatcggaagtgaacctcatgaataaaaagcagaaaatcatgctgatccgcattctgacagcggcggccctgctggctgtcctgcatgttctccccgtcacaggctggatgcggtttgggctgtacctgatcccctatctgatcgcaggttacgacatcctgcgaaaggccctgaagggcatccaaaaccgccaggtgttcgacgagaacttcctgatggccgtggccactgtgggcgccattgccctggccctgtacgagcggagcggggattacaccgaggccatcgccgtcatgctgttctatcagatcggcgagtggttccagagctatgcagtaggccggagccgccggaacatcagtgagctgatggacatccgcccggactacgccaacgtggaacaggacgggaagctggagcaggtagacccggacgaggtgtccatcggcaccgttattgtggtccagcccggcgagaaggttcctatcgacggcactgtggtggagggcgcctccaccctgaataccgccgccctcaccggcgagtccctgccccgggaggtccgggagggggacgagatcatcagcggctgcgtcaacatgaccgggctgctgaaaatccgtaccacccgggaattcggcgagtccacggtgtccaagatcctggacctggtggagaacgcctcctcccgcaagtctcggtcggaggacttcatctctcggttcgcccgggtgtatacccccgccgtgtgtttcgccgccctggccctggccatcctggtccctctggcccggacgctccttctgggcctgcccgccggctggagcgtctgggtctaccgggccctcaccttcctggtggccagctgtccctgcgctctggtcatcagcatccctctcagcttctttgccggcatcggcggggccagcaacgccggcgtgctggtgaagggctctaactatctggagactctgtcccaaaccaaaacggtggtctttgacaagaccggcactctgacccagggcgtgtttgaggtcaacggcatccaccatcatgaaatggagaacgagaagctggtggagtacgccgctctggcggagagcgcttccagccaccccatcagcaaaagcctgcagcgggcctatggccgggagatcgaccgcagccgggtgacggatgttcaggagatcagcggcagcggcgtcatcgccaaagtggacggcgtggaggtagccgccggcaacgacaagctgatggaccggctgggcgtgccgtacatcccctgtcacagcgtaggcaccatcatccacatggccgtcggcgggaagtatgccggacatatcgtcatctccgacgtggtgaagccccacgcccgggaggctgtccaggcgctgcggtccgccggtgttcataggaccgtcatgctcaccggcgacgccaagccggtggcagaccaggtggcccagtccctgggcatcgatcaggtttacgccgagttgctccccgccggaaaggtggaaaaggtggaagaactgctgctggacaactctgagcggggaaagctggccttcgtgggggacggcatcaacgacgccccggtcctcagccgggcggatatcggtattgccatgggcgccatgggctccgatgccgccatcgaggccgccgacgtggtcctgatggatgacgatcccgccaaaatcgcaaaggccatccggatctcccgcaagtgcctgcggatcgtctatgaaaacatcgtctttgccatcggcatcaagctggcgtgtctggtgcttgtggccctggggttcgccaatatgtggctggccatcttcgccgatgtgggtgtgatgatcctggcagtgctcaacgccatccgtgcgctgttcgtcaaaaagctgtgaacgcggaaagcgccccgtccaaggctgcacgggcatgtcccggagtccggcggcagagccccaggcaaaggcagccctccggtcaagcgtgaagggaccaaatccgcacaaaaacccggcgccgggaattcccggcgccgggttctgtatgtacagaccaggtcaaaatgcaaagagtaaatgtcatttcagtaaaattgaacacggccatgacgttccctgcttattggtgaatagcctggaattccgtagggaactgcagcttatgtgatcacaagattttcaaatcatgtgttcttttctttcctggtgttttcaaacacccagaatatagcgcccagaatcacaatcccaccaattatggagcttttgctcagggtctctcccaaaaaggcatagctgaacacggcagtgaacacaacaccggaatactgatagatgctgacctcagaggccggggcctgctgataagcgtatgtcaggaagaactgtccccctgccgcaaagacgccgatcagcaaaagcatcacgaatacctttggagacggaatcaccagattcggcagcatcatcagtcctgcgcagaccgtactcagtgcggaaaagtggaagataatcgcagatgggtgcgtgaaatttttacagtaggacaacatggtgtaagccatgccggataccaccgctgccagcaaagccgccagaagcgggaacgggttggagtcgaaggacggctgcatggcgatatatgcgcccacaagacacaggatcgttgaggcgatcttgacgggagtgatcttctccttcaggaaaataccggcgagcagtgtgacaaataccggagatgcccggttcagcatagctacatccgcttggcgggcgtgaccggccgcatagaagaagagcacgatccccagaaagccgaagaacgaccttccccaaagcgcccagccccctcgtttgatctcctgaaaaacctgcaggttttcccgtcggaccataacagctgcaataatcaggctgacaagattgcggaagaaggtctgctcaaatgtccccacctcttcagagctcaatttgacaaatacctgcatgatggaaaaggacagcgatgagaccagcatcaaatatatagctttggttttttgtttttcgtaatcagtctctccttttatatggcaacatacagcgtggccgtctgcacgggaaatcagcgcagacgaccggaatacacttccggtcgtctgttccgatcccacccggggcctgcgcagcagaaatcaatagtcgccgttgtaactggttccgtggggcgttgtccagctataatctcccagcttttccgcctttgtctcctcgccgttggccacacgcagaagcagctcgtaaagctcgcggccgctttcttgcaggctcagttccccatacagcatgggagctgcggagtagtcgatcatgtcctccagcgccgtcgcagtctgggggttgcctgtgatcttgatggtcgtcatacatgcgttgccgatggggttgccccgcccagtggtgaagaggcagatatggcatccgctcatggccagcgtggtggacgcataggcatcattggcgccctgtgcctggttgatgccccaggctcccgcgccggggaccggatcaccgcagtccaggatccccaggatccggcgatgtccctgggttttgaagctgcccaggttcttctcggtcatagtggtcagtccgcccgccttattgccgggagtgggattgacctgggagaggcccttaccgcctctgcgggtgcagtcctcattgaagaaatctccgatatccatcaggcgcatgccgatctcataagaagccgctgtggtgggatagccgccgcggccacaaacctccaccgctcttccgccggcggacaggtgcatatcgattgcctcacccaccaccggattggcggacaggccgctggtccagtcagatccgccgttatagccgccgataatcagtccgctgagggggcagggttcgcgcttctgggcctctgcctgccgcttcagatcctccacagctgcaatcccgtcctggatggccttggtgacaccgccgtccgcctggatgctgatattcaccaccggccggccagtcttacggatctcctccgccacatcttcaggatctgtctgctggcaccccagggacagcagtaccacgccaaaagtgttcgggtgcgtgccggttgtgatgaatcctctgcgggtccgctcaaagcgatccggaaactcaccgcaagccgcatcgacaaacgtggcagggacattacaggcagcagagatccgctgcgccgcattgttggagcactgaaccagagagatcaccaccacctggttccggatcccaaaggaaccgtctgcccgcttatagcccatgatcgtctccggcaggcccaactcttcctttttgtatttatggtggatcgtgtaatccatggcatccggtgccatggagcgatagtaagcacgctgttcccggttgatttcctcaaagtcatcgtaaacattgtgctcatgtacccagtctccctttttgatgaactgggtggccacgccgatatgtacaccatacttgatgatctcggctcctttttcgatatcagtgcgggcgattttgtgcccctctttgatatattcgttggccgtgatctcctcaccagccactagtgtgcactcacccgcctggataggctctacggcaactgcgacgttgtcgctctcctcaatcagcatgctttttttgtaaattttcattcctgtttactcctccagtaatttaggattggtgttctcttaccgtaatactgcggcgatgcgatccatgatctcctcgatcagatttcggggtgcagccaggttcaatcgttcaaatccatttccctctgggccgaacatactgccttcgtccatcgccacatgggcctgatacagcatcttttggcgcagtttttcggcatccggctccagtctccggaagtcaatccattggagataggtcccctccagaggggagatcttgacgtctccattccaagtatcttccgcaaactcccgaacgaactggtcatttttctgaatataagccaggcatgaatccagccaggcttccccgtggtcccaggcagcctttgcagcaacgggggcaaaaaagttcggatgggcacgacaataccgtgcgaacatctggtcaaatcgtttccggcgttcctcattggggatcataatgcaggaaaaagaaagccccgccagattgaatgttttggatggagcatggcaaacggcacagttttccgcatagtcctggcccagcgaggcaaacacgatatgctggtggcccgggaagatcagatcgctgtggatctcatctgcgattacaaacacatgatgcctgcggcagatctcgcccactctgcggagctcctcctccgtataaacacggcccaccggattgtgcgggttgcttaaaacaaaggccctgcatctgggggatgccgctttcctctcaaaatctgcaaagtcgatctcatagcgcccatccctgagctgtaacggactgtttacaacaacccgtttctgctgctgtatcgaatcagcgaagggataatacaccggtctctggatcaggacctcatcgccttcctccgtctctgacagcagcaggagattgatggctgtcacgacaccgggggtaaaacggaaccagtccgccgccgcattccagccatttctccgttgctgccagcgcagataggacgcaataacctcatcagtgactttggtatatccatacatgccgttcttagctgcctcaatgatggcttcctgaacctccggaagcgtcttcagatccatatctgcaatccaggcgggcagaacgtcttgggttccaaaagtcttttccagttcagctggctcccacttaacctgcccccacggcaggcggctttcaaagtggtcaaagtcaaacgttttttccatccttacctctttctgatcctaaatcgggatttatcacaggccattaatctccctcacaaaatggcatttgacaaaatgatccttttcgatctcttccagctggggctcattttcaaaacattccggcttcgcatatacacatctgggggcgaagcggcaggactttgtcacgttgataggcgaagtgatctcacccttcaaaatgatctgattatccggcgcattgtacttgggcagcgggatcgcagaaatcaatgcctttgtatagggatgatattggtgggcaaagatctctgcggatccagccttctctaccatctgtcccagatacatcaccgtgatatcatcggagatatgcttgaccacggacaggttgtgggtgataaacagatatgtgagattccgctccttctggagctccatcatcaggttcagaatctgtgcctgaatggacacgtccaaagcagagaccggctcatcgcagaccaccagcttgggatccagaatcagcgcccgggcgatacctacccgctggcggcgtccaccatccagttcatgcggatacaggccataggttctctctgccagtcccaccacatccatgatctcacggacttttttctgctgctcctctttggaattgcagagcttatagatcttcaaaggctctgcgatgatatctccgatggacattctggggttcagagatgcgtagggatcctggaaaatgatctgcatatccttgcgaagctctttcagctgcgccttggtcacgtccgagatatcctttccctgaaagataatccggccgcctgttctctgatgcaggtgcaggatcacccggcccagtgtagactttccgcagccggattctcccacgatccccagcgtctgtccctcccgcagaccgaaggtgacgccatccactgcatggagtgtcccctttttggtggcaaaatactttgtcaggtcttctactcttaaaatctcagccatactcaaacctccgtgtcagaaaaacggttgcagcggaccatgtgagagtccgaaagcttcaccggcttgatttttccggtctggcaggcttctgtcgcatagggacatctggggtggaacttgcatccatccggaaggtttgcggggtccggtaccatgccctgaatcactttcagcgtagatgcgtcgttctcaatatccggcagagagtcaaacagaccgatggtatacggatgccgcttatctgtataaatttccttgagggttccggattccacgatctccccggcgtacaccaccgcgaccttgtcgcagatcttcgccacaacgcccagatcatgagtgatgaggatcagggaggtctgatactcctgcttcaattttttcatcagctccagcacctgcgcctggatcgtcacgtccaaggctgtggtaggctcgtccgcgatcagcagctctgggctgcaggccagggcgatagcgatcatcacccgctgcttcatgccgccggaaaactggtgggggtagtcgtcgcaacgggcgccggggatacccacctgctccagcatctccatagcacgcttccgggcctcggccttcgagatcttgttgtgcagcaggatcacttctgcaatctgatctcctacccgtgtcaccgggttcagggaagtcatgggatcctggaagatcatggagatctttccgccgcggatccggcgcatctgcttttctgagagtttcagcagatcctctccctcaaacaggatcgatccctttacgatctctcctggcggatccggcaccagccccatgattccaagggccgtggtggtctttccggcaccggtctcccccaccaggccgatactttcgcccctctccagagaaaaggtgatgtcattcaccgcctgcacagtttcctcgtctgtcacataacggatttcaaggtcgtgcacttccaatatattttcagccataccgtactcctttcaccgctcacttcttcaatctggggtccaggcagtcccgcaggccatctcctacaacgttgagtgcatagaccaccaccatgatggcaaggccgggaatgaccgtgaggtaaggttctgtccggatgtaccgccggccggtggacagcattgcgccccactccggcagcggagcctgaatgccaaatcccaggaaactcagagcagaagcggaaatgatggcgcccgccatggccagtgtggcctgcacgatcagagaggaaatagaattgggaagaatgtggtggacaatgatacgccagttattggcgccgatggctcgggccgcctcgacaaactcctgttcccgtgttgacataactgctgcccgcaccacgcgcgcgaattttggcgtagaagacaggcccaccgccagcatcaggttgaacaagctggaacccagtgccgtgacaatgcacatggccagcagcatctggggaatggccatgaacagatccatacagcgcataatgatattgtccagcttgggatagtaggctgccaggacacccaaaattccgcctgtaatgacagaaattccaaccgccaggaagccgatggccagagaataacggctgccatagatcaggcggctcaactggtcccggccaaggttgtctgtgccgaaaatatgctctgcgcagggcgcgatcatggcacggctggcatcctgatcatcatatccgtatggtgcgatctgatcggcgaaaattgcgatgagaacgaaaaggatcaaaacgatcagtcccaccagcgcctgcttgttctttttaaaacgtctccagatttcggagagcatactgtgatttttcatgccgccttcttctctcctctcttcttgaaacggaagaacccgctcttggagctctcatacatggtcttcatgcgggggtcaataaacgtgtagatgatatctacaatcaggttcaaaatggccgagacaaacgcgatcagcagcacacatccctgcacggcagcatagtctcgggcattcatggaatccaccaggtactttcccacgccattgatggagaaaatcacctctgtgacaatggagccggccagcagaacacctagctgcagcccgattacggtgacaatggggatcatagcatttttcaatgcatggctcaggattaccatccaataagtctggccctttgccttggccgtgcggatatagtcctgccgcataacctccagcatggagctgcgggttgtccgcatgatagtggcagaggaattcacgcccagcgcaaccaccggcatgatcatctgcgtccagctattcccgtagcccgaagccggaagccagcccagtccaacggagaaaatcagaatcagcatcaggccctgccagaacatcggcatggaaattccaaataaagcgcaccctgtgcacagagagtccagaatggtgttctgtttcagagcagctacgattccgaagaatattccaagtataatgcccagaacaatgctccatgcggagatattgaatgttacagagaagcgcacgagaagttcgttcaaaaccggagttctggagcggtaggagattccaaggtccccctgaaacaggcccagcagtgtccttcccagccgctcccagtaggtcccgttgatccccatctcaatgcggtatgcctcaacagcttccggcgtggcgttatctcccaaggccagataagcaggatcaccaggagaaaaatagagaattgtaaaaacaacaatggttacaccgatcaatatgggaatgatccataagattcgcttgataatgtatttcagcatggttcgttttcctcactcaaccagcgcggcgccccggaggccaccgcttttttgtactgtcatgtaaaaaaataggatgggtgaataattgttgtattatccacccatcccttggatcaaatcaaacccttaatccggagaatcattttacgcgaagtagcaatacttcagcagcggagcctggaatgcgccattgcggaagccctgcagatcgctggtgtagcagtggatatcctcctgctgatagatgggaacgatgacacattcatccagcaccttctgctggatttctgcattcagttcgctgcgctttgcagagtccgcctccatagcagcagcatcaatcagggcatccatctcaggatcgctgtatccgaagatgttgttggcgttatcggtgtagaagaatcggttcgcatagtcaatatcgccgttggtggcagagatgccccaggtataaatatcgaagttgtgctccaccttcaaagcctgagagtttgtggcagcgtccaaagcaacgatctccacatcaataccgatctgccccagtgcattggcaaagaactcaccataggcctgacgcacagccatgtggcccacgtgatatctgcaggagaacccgtcggggtaaccggcctctgccagcagttctttggccttctcaagattatattcatagaccggataatccacatgatagggagagtccacatccgcgatggaatcaggaatattgctgggcagcaggccttccgcgggctgaccgacaccgtccatgcagacctcccatgcaccgtcaatatccagtgcataagcgatagcctggcggacacggacatcgtcaaagggagaattccgcagattgaagctcagatagcagttgtccgtcgtatactcacggaataccacaacatcagaattggcctcggcagcctcgatatccacgccggaaagattgtagcacatatctgcgccgccggtctccacctcgatgtagcggttgccatcttcggaaatcactctgaattccacattcttgatggcaggctggccctccacatagtagtcgtcgaagcccaccagactcacgctgctgccgatagaccattcgccccaggtataaggaccggtaccgatgtccatattggcccaatccccgtttccttcctcatatcccttctggctgaacatcacgcaggtagggaatgagaggttggcgattacaggcatatagggttcgtccatcacgatgacaaaagtcctctcatccaccgcatagctgttttccagatccatatggtcggtaacagaggtgttggagctctcccgcaggcagcgcagagagaagaggcaatcctcggccgtcaaaggctcgccgttatggcacatgacgccttcccgaagagtcattgtcagctcagtggcatcatcgttgaattcccaggattcggccagaagcggcttgtactctccttccggcactgtgcgctcgatcagggtctcgtagacatttgccttgatcttcaaagtatcattggtgctgcttccgttgatagggtccttgtctgccatatctgcctgaacggcaatagtcagagtatctttcgcctctcccccatcatcgccgtttccggcatcttctgtgccgccgccacatgcagttgtcaacatgcagagacacagcacggaggaaaaaatccgcagcaacttttttttcataacatctcttctcctttttcatattttacaatcaccggttttcaccggaaactgccatttttgttgccccctttaaaaccggtcatagctgacgatttcttccatattcttttttgtcttccgggggctgttgtccgcaccatatccgagcgctaccatagatacgacccgcgcagatgccggaacatgcagcaaatctttgaccgcatcttctctaaatgcacagatgatacacgtatctaacccctgttctgccgcttccagcagagcaaatcctgtggccagagacatgtccactacatagccatattgcccgcagggcattacaaaatctgtgcggtccgtagcgcagaacaccaaaagtacatctgcttcctccaccatgggctgtgtctcagcctgctggcggatctgctgcttcaaggcactgtcccgtaccacgatcacccggatattctgatcgttatgtcgggaaggcgtcaggcggacagcctccagaactgcattgagtttttcctgttccaccttgcggggcagatagctccgcacacttcttctagccttcatggcccctatgacatccatgccttttcctccaaaagccgctggtcagcggaccatctcctgaatctcctccagcgtcttgccggccatccccagcttttctgcggtgcgtccctctttccagaagtcccgaccgcagacagcactggcgatattgacaaaggcgtccatcatcggggtggggatgcccaatgcatggcccacggaagccagaggtaccaagccggacatggtatcctccacgatgaaccggtgcttggtattggtcgggttgcgcagagcgcgataggattcgatgctctgaatcagatcatacaggctgtccttcggctccagcttgtaggtcttgaccagcatatccccagcgccagcgcatccacgcccagcgccctgcatacagcgacacgctccttgtcgcaagcggagatgatatcggcaatatgtggggtgattccctccatgtaatagtcgtagctctgccccagatccatcttgttgatgttcatgaggctggggatggggtgcagcatggcgccggcgccctcaaagccggtctccagcacattggccgcaggctgcaggcaggggaagatgggtcccagcactttcatcaggcggtcgatatcactggcgggcagtgtcgccaccggcacgtggaccttcaggcccgtgtgaaggatattgccgacctcataactgcggcagccatacatcaggtcccccgcctccgcaatgataagatccttgccgcagccatcctcgccgcgcaggatattggcgatctccagagcacctccgcagtggccgggattcagcatgacgatctgcccatccttcagatagggcttgcaggcataggcgatgcttctatgggcatccgtagtagagacgaccatgatcacgtccacgtcatccatgacttcatcgatccggtccgtaataaccgccggtgcggcctcgcaggcaatgacgccggtgaccttgattgttttgagttcctgcagacgatggattttttccttgtcgatgtcatacagcttggcgatatagcccttgctggtgagaatggcggccatgctctgtccgcctgcgcccgctccgataatcgcaaatttcaacatcttgattccctccacatttcattttcctatggaatttgaacaaacgtattttgctttgaaaaaatacccaagggcgtttctccttaggtgttgtttccatttccaaaattaccgcggcttctatgcctgattgaaggtgatctcgtcagctcttttcctgtccgtactgctcctctctgcaaacattgtgttttttgtctgatcctgtcctgttttgcttgtcttaattttatcacattgacaggaaatccgtttatatggtattgttagtactaaatatatgaatttcatatctttacgggcacacttcagggagactgtctctcccgggcgcacgccggatctcctgtccgacttccgcgtttttccggactgtgacaggacattggagagcaatcccaaaggcccctcagcaaactgggcggaaaatgccgaggctgtctaggggggcattattatgtacggagggaggatccaacatgacgttccaacagctcagcttcgtggtagaggtcgccaactgcgaatccatcaacaaagccgccgagcggctctatacgtcccagagcaatgtcagcaacagcatcaaggccttggaggaagaattgggaatccagatcttccttcgaaccaaaaagggcgtttccgtcacggaagaggggcgggagttcttgagctatgcaaacgagatcatagacaaaaaaatttttgtagaagatctgtatgcaaagagccacttccgcaagcagtatttcagtgtctcttccatgcgatccttctttctcagcacgcccatcacaaggctttggccgcagatttcagacggccacggcggctctatctatatcaggctgaaaaaacagtctttttacgatgttctggatgatgtgcagcactgccgctccgacctggggatcgtcttcctgatgaaatcccacagtaatcggatcacgcggctttgcagcgtaaaggacttggattaccatctgttgggggagagccatatcagcatcgtcacgagagcggaccaccccattctgcaggctcaggagaccgttccggtggaagaccgtatgacggactatccctatgtgattgcagaaaaccacgagaatttcggcagattttacgatgatgattccgagtccatctctcaactgtttcagtctcccccaaaatgcatcatctctattaacgacagtgctgccagccaggatattgtggcccaatccgatgcttttttcatcagttctacccgctggcagcatccgcagcactaccatttttcctcggtcccgcttaagggagaagatagtatcctggcccattattatgtcaccaagaaggggcagacgcctcaccctttgaccgctccctatgtggaagaactgaaaaaaatgttccatggtctttaacgaggatattccgacatactgagcaaacagcgacatggagcagcctccttccatcctcaaatctccccttccgaaacacttctctgcccagtctcgtctcggcctcgcatcctgtgccttttattacataaaacctgcttgctccaggcggagattcagaaactgctgatccagagtataacttggaccatccttgctcatccatacccgggatttttctcagattttcttctataaaagaatgatgaatgagattttttctggcgtggagggtgttccggacagctacttttccctgtggatgaccgttggccgcatctaagcgggaactctgctgggctatggtatctatgcggcgatagcccccagaataaggatgtccttccgagtctcgtaaatacggacagcatcgtcccccccctgccctgttccgtaaagagtggtctatccttcagcccgtctggagttcctggcaggcgcaggatatggattttacgggggcaatacacagcaagtaattggctggacataggaatatttacacaggtattgaataagatcggacgccgcaccaatggacttttggtgcggcgtcccaatatattcttcaaaatgacagccccgagatagatttctaatgtttctgagccaattgtttatgaatgtgttttgtctggggacaccggaaattttatatttccgcttctaacgcttctgcaaccgtttccagcagatcacgggcggaagcctctgcgggcaattttctcccgcaggccacagcggatgcagtcggatgcctttctgtaagtctggggcagagccgcataatacgcctcctggttggcagtgtagcccgtgttgttccccaatcgctccggatttctcatgccgcttaaaacagtcaaagccccgtccagccccgcaatgagccggatggaccaggaggaggccggtccggcggtcgcatcagcttggtacagcagcacagcggcctcctccggtaagttcatcagagcacctcccttcaccggctccacgaccgcaatctctttcccgtatctccgggccacctcatcgcacttccggcactggagattgggatccctcccagtccggacagttgcgctgaagctgcaccagctcaactatctggatgatcttgggggatcttctccagggcctccgcagctcttcggaaagaacaactgatatgctgcgccaactccttgtctcgcatttcacggggaaaccggaagctgccaactggatctggtccgggagccggatcgaaccatgactgtgtggtaaaagggatcgtcatgtaacccttgtcatgcttgccctcagagcactttttctctatgaattgatgcgcagcctcgtttacaggggcattggggagatatccacccatcagcaggaaaagttctgtaacgaagcggaattgcggatgtaaatatctatttgaccagactggtaaggcgatgcatcaataccggcaaaagccaccgacgccgtcttggagtggaaacggcggacatcgccaatctccgccataagttgtgagccgagcgatggaccaacaccaaatatcctcatcaccacgggatattccgggcgtgaagatgcccaagatcgcatttgcagttttgcagtttcagggcggccaatgctgcacaggccgtccggagttgagagacagcccgttctgccagaagtctggcagtatcagttttcggcataacaccaaagtgactacgggcagaagcataaatatccaatgccctatcttcgctgaagttgtagctatatttcttacaccacctttggtatttggaaataaatgctttttcacataaaacgcaaacgcactcacagttccaaaatgtcgctgcgaagtccaccatttctcgctgccatcggtacgcggagggcttgaaaacaggcggtttgcgcccggaaaagctgtgtctaacagagagatcaggttgttcttcaacttttgaatacggctggtattgcctggcagcagtttctgcgcatcaatcaggtatctatacctcgccaagataagccagtggccaagaccgtcgtttgccggtttaatggcatccttcttgtcggtcttggcacggcgcaaattggcaccagcgctgcactgactgccgaagcatagaatccggaggcattcagcagtcaggcttccggtaaatgataattacccgtagactccattacaacacggggcttgcctggcagcccgcgaagcagtgatcgttcgctgtctgtatgttgccccattgtggctgaatcttgggaacgaatgaagcacgtctgacgggtgtgcttcacccgttgtagtagcgtccaaataggagaaaactggtaggagccatttcgatggaatcgctcctgtagaaaaggctaaaaacttcaagatataaccgttttctaagagataaaatcagaaacaacatccacgagatgcgggggagaaagctggcgggcagaacaggattcagctagttgatgggcggttccgtaatcgttggaaaaaggggcagtaactgctactgtaatccaacttcggcctattttttctttagcaagaatgccgtaagatctggaagataaagaatgtatcttaaatacctcatacttgtacatgaccagtcacctcagtatccccggattcttttgctgcatgggtatgaacaagagactcctgacgtttagatgcagttattggagtgccagaggcttccatcagatctttcagaaagctattcatatcaatttcgagaaagactgcaagtttgattgcgagaaaaaagccaggcatcttcttaccagattcaattttctgaatccatccatgggaggtcccaaccgcctctgcaagttgagcctgtgtcagttgaaattgcgtacgtttgagaaggacgtgctttgaaaaaattcgtcgtaaagttatttttgtcatgggaaaatccctccttatatagaggattttaaccatgaactataaaaatttggacggacctatagttcttgttggatagagcaacagaaaaacatcggattttgtcgcaaaacacataaaagcaagcccgcttctagcgagcttgcttgcagagatagatcacgtgttaaactgctctgcgaaatagcagtttcgtcacccaatgtcatccaattttcacgtattcttgcctgagcctccttgcaagatgtctctatctactccccctgtttcatggatgctgccggaatcagatatccctcttgcaatacaaccaagaaaatcatataataaatctataaattgtgcattttatataatttcaggatgtggttgcaggatggatacttacgcctatctggcccatctcacagaagacggccggacccagacaattctggaacatctcaaaggcaccgcgtctctgtgttccgctttcgcagctgcttttgacgcagaggcgcagggacagctggccggtatggctcacgacatcggaaaatactccgctgcctttcagcggcggctccatggcgggccgaaagtggatcacgcctctgccggggctttcgagtgtctgaaagctcaacagctggcggctgcttttgcgatctccggacaccacggcggcctccccgacggcggcggccggggagacgccgctggcgccggcaccttttgggggcgcatcaatcgggcgagtcaagggaggctggaggactatcatgcctggcagagtgaattctccctgcctcatgcaaatacccccgcatttgcgggaacaaggctggaggggatgtttttcacgcggatgctcttttcctgcctggtagatgcagactacacagatacgggcgcgtttatggacaacagcccgtatctgccagcatcgtcctcctctatggaggaattgtggcgccgcctggaaacctatgtctccggctggtttcccccaaaaggcgctctgaacatgcagcgatgtgtgattttggaacagtgcatgtcggcgggggcacagtatggaccaggcctcttcacgctgacagtgcccaccggcggaggaaaaaccgtggcatccctgtcctttgcgctggcgcaggccaaagcccgcaggatgaagcgaatcgtttatgtgatcccctacacatcgattatcgagcagactgcccaggcctttcgggagattttgggtgatgaaaatgttctggaatttcactccggtgtgcagttcgaccagcaggaggacgatgcatccagtccggaggccgttccgctgacccggtctgtggagacgtgggatgttcctgtaatcgtcaccacagcagtccaattctttgaatccctttatgcctgccagccttccaaatgccggaagctccacaacctggcccagagcgtcctgatctttgacgaggcccagatgctccccctcccctatctgcgaccctgtgtctgggcgattgcccagctggtccggcactacggcgcttccgctgttttgtgtaccgccactcagcccgctttggaccccatttttcaggaattcgctccggagatccccatccgggagatttgccccatggccgaagcgcactgggagtccttccgccgggtttccttccagcaggcaggaacgctgtcctggatggacctggccgcccgcctgcagcagcaggagcaggttctgtgcgtcgtcaacacccgccgggccgcgcgggaggtcttccaccaactgtccggtccaggcaatttccatctctccaccctgatgtaccccgcgcaccgcaggagaattctggatgagatccgccggcgcctgcgggatgggctgccctgccgggtggtctccacctctctcatcgaggccggtgtcgatgtggatttcccagccgtctatcgggagctgtccggtctggactccatcctccaggccgctgggcggtgcaaccgggagggcaagcgccctccggaggacagcatcgtcaccatctttcagggagaagatccacctccccgtctgtttgagacctccatcggcgccgggaagatcgtcctggatcactgccaggacgtcagttcccgagcggccatacacacctatttctccacgttgctggatttgaaaggcgcggaagctcaggatgcccaccacatcctgccgctgatggaatcggagttcttccccttccgcactgtggcggagcgattccacctgattgaaagccccaccacaaccgtgtaccttcctctggaggagggcgccggacttgtggaattgctgcggagcggtcaatacagccgcacactgtaccgccgcctggggcaatacggcgtgtcggtctatccgcagcatttagcggcattggagcaggcaggggcgctggagcatctggaggacggctccgtggtcctgcgggatattgggctgtatacacagactaccgggctgactctggagcccagcggtggaaatgccctgttcatcggataggccggagaatccattgaaatacctataccaaaatctgtctatggagcggtacgctgctccacccttccacaaacgaaagaaaggagtgcatgctgatgcccatctctttggaggtctgggggactacgccctcttcaccagaccggagatgaaggtggaacgggtcagctatgatgtcatgaccccttcggcagcccgggggctgatcgaggcaatttactggcatccggggctgcggtgggtgatcgactgcatccacgtgtgcgcgccgatccggttcaccaatctgcggcgcaatgaggtgaagtccactctctccgcccggtctgtccgcaccgtcatggaacgcgggaccggagagctgtatctctgtactgccaacgacatccagcagcgggcggcgctgctgctgcgggatgtgcactatgtcattgaggcccattttgatgtgacggacaaagccgctcccggggataacccgggcaagttccaggacattgtcaagcgccgcatccagcgggggcagttctatcatcagccctgcttcggctgccgggaatttcccgcccagttccgttggtgcgaggagccgccgccctgtccggaggagctgaaagggccaagggatctgggctggatgctgtatgacatggattacacgaacccggaggatatccgccccctgttcttccgggcgtccctggaagacggcgtcctgcgggtccctgggcggaacagcagggaggtgcggggatgatcttacaggcgctgaccgactactaccgggtactggaacaggccgggaagatcgacgcccccggctgggcgccggtgaaggtgtcctatgcgctgctgctctcggaaaacggcacgctggagcaggtgcttgacattcagacggaacagccgcggggaaagaagatggtttccgcgccgcagatcctctccctccccgcgcctgtgaaacgaacggtgggagtggccgccaacttcctctgcgacaacgccggttatctgctggggatcgacagcaagggcaagccccagcgaacgcgggagtgctttgaagccagcagatctctacacgagcggctgctggcgggtgtagactcccccgccgcccgggcggtcaccgctttcttccgctcttgggaccccgagacagcccgggaacaccccgctctggcggagcatctggaggacatcctctccggcggcaacctgatcttccgcaccctggacggctatgtccacagggacccctccgtccggagggcctgggacgcatcctatcagaccaagggggatggtcctcagggaatctgtttggtcaccgggcagccgggaccggtggaaagcgtccaccccgccatcaaaaatgtggcgggtgcccagtccagcggagcggccctggtgtccttcaacgccccggccttctgctcctacggaaaggagcagaacctcaacgctcccaccggcaagtatgcggcatttgcatatacctctgcattgaacgcgctcctggccgaccgggaacacgtctttcgcgtgggcgatgctaccgtcgtctgctgggccagaagcggagagcggggatatcaggacgtctttcagacgtttttctccgatttctatgacgaaacggacctgaaagggctggttggcgccttgtgtcagggcaatccggtggtctacgatgagacaaaactggaccccagcatggacttttacatcctgggcctgtctcccaattccgcccgcctgtcggtgcggtttttcctccacaatacgttcggcgggtttctgcggaatgtccaggcccattatgaccggctggagatcgtccgcccggcctacgacaaatttgagacgctgcccctctggaagctgctcagtgagaccgtcaaccaaaatgccagggacaaatcccctgctcccgacctggccggtgaagtgctgcgggcagtcctgaccaatacccggtatcccgccacgctgctgaacggcgcggcccttcggatccgggcggagcgggaggtcactcgggggcgggcagccatcgtaaaagcctactaccaaaagcttgcagaaactaccaaacacgaaaatccagacataccagaggaggtcttgcaagtgtccctgaatccggatgcatcgaacgtgccctatacgctgggccggctcttttccctgttggaagccattcaggcctctgcaaatcccggcatcaacgccaccatcaaggacaagtatttcaactccgccgccgctacgccggccgtgatttttcccgttctcatcaatctggcgcagaagcatctgaaaaagctgcgcggctccaacgcagggctggtggtcttctatgaaaaacagctgacagagctttgcagccgcattgggaaagcgtatcccgcccacatgaatctgccccagcagggctcgttccagctgggctactactgccagacccaggcccgctatcagaaaaaggaggaagcgaaagatgtctgaacccatcaagaaccgctatgaatttgtcattctctttgacgtggaaaatggcaaccccaatggagacccggatgcggggaatatgccccgggtagatcccgaaaccggcctgggccttgtcacggacgtgtgcctgaagagaaaaatccgcaattatgtagagacggtcaaggaagacgctgccggctaccgcatctatgtgaaggacggggtccctctcaaccggagcgatgccgaggcctacaaggcgctggatgtcgatgaaaaaaccgctaaggagaagaaaaaagccgatccggaactggaccgaaaaatccgggactggatgtgcgccaacttctacgacatccgcgccttcggcgcggtgatgaccacgtttatgaaggccgccctgaactgcgggcaggtccgcggcccggtgcagctgggctttgcccgcagcgtggagcccgttatcccccaggagatcaccattacacgggtggccatcactaccgaggcggacgcggagaaaaaggggacggagatgggccgcaagtacatcgtcccctatggactgtaccggtgcgagggctatatctccgccaatctggccagcaagaccaccggtttctccgaggaggacctgtccctgctgtgggaggccatcctcaacatgttcgagaacgatcactccgccgcccgcggcaagatggcagtccgggagctgatcgtcttcaggcacgacagcgagctgggctgcgcccccgcctggaagctgttcgacacggtaaagatcgcccgaaaggacccggcggacgcctcccccgcccgctcctttggagactacactgtctcagtggacgagtccgcgctgcccgccggcatcacctgtacccgcatggggtgattgatttttctgaggacctcctccccctctccggtctgcagcacttcgcgttctgccggcggcagtgggcactgatccatctggagcagcaatggcaggagaacctgcggactgtggagggcggccttctccatcgcagagcccacgacgaggcggcccgggagcggcggggcgataccctgatcctccggggattgcaggtggtctcccatcaactggggctttccggccagtgcgacgtggtggaattccacgccacccccaaaggcgtaccgcttcagggggaggaggggctttggcagccgtatcccgtggagtataagcggggaaagcccaaatcccatcaggcggatgaactgcagctgtgcgcccaggccatgtgcctggaggagatgctctgctgctctattccagaaggcgctctgttctatggggagccacgccgccgcacggtggtgctcttcaccccggagctacgggagacggtgcgcagggactccgacgaaatgcaccagctgtaccatcgaggccatacgcccaaggccaagccctccaaatcctgcaacgcctgctctctcaaggagctgtgcctgccccagctggtccggcgggagagcgtccagacgtatctgcgccgcgccatggaggaatcgccatgagacatcttctgaatacgctgtttgtcaacagtgaggacatctacctgtctctggacggggagaatgtggtggccagccgcggcaagcaggagatggctcgctatcccctccacattctctccggtatcgtctccttctcctacgccggcgcctctccggcgctgatgggggcctgtgtccagagggatgtgtctctggcgttctgcacgccccggggacggtttctcgcccgggtatccggggaatcctccgggaatgtgctgctgcagcggacacagtaccggacagcagatgatcccggcccctgctgccggatcgcccgcaacatgatctttggaaaggtgcacaacacccggtggagcgttgagcgtacccggcgggaccacggcctccggatagatgaaagcgcgttttccaacgcctccgcccagctgcgggcgctgctgccccagatcgccgccgaaacctccctggagcagctgcggggcctggagggcgccggggccacgatctacttcagcgtgtttgaccagatgatcttaggggagaaaccgctgtttgccttttcgaaccgaaaccgccggccgccgctggacccggtcaacgccctgctgtccttcgcatacagcctgctgacgcacgactgtgcctccgctctggagagcgtggggctggacgcctatgtgggatttctccaccgggaccgccccgggcgaacctcttttgccctggacttgatggaggaactgcgtccctgccttgcggaccgcttcgtcctgactctaatcaacaatcgtgtcgtgcacagggacgacttccagttccgggaaaatggggcggtctatctgacggactccggccgcaaggtctttttgacccactggcaggagcggaaaaaagctgaactgacgcacccctatctgggagagaagatcccctggggcctggtcccctatgtacaggcgctgctgttggcccggactctgcgggacgacctggaggaatacccgccctttttgtggaagtgaggcgtccgaatgctggtactgattacctatgatgtgaacacggaggaccccgccggccgcaaacgcctgcggcagatcgccaggcagtgcgtcaactacggccagcgggtccagaactccgtctttgagtgtatgctggacactgcccagtgcaaggtgctgcaggccaaactgctctccatcatggacccggaaagagatagtctgcggttttactatctgggaaagcgctatgaaaacaagatcgagcacttcggcaatcagcgcagctaccaaccggaggcccctctgatcctctgagtgcgaaggggaagcgaacatcgttttcccggcaggttcgcactcaaatatcatcaaatggacaggagatttccgtaaatttaagcgtgcgaactgtgacacagacacggctcctggccattccagtttacgaaattgcacatttgtcacaaaacatacctgtgcctttgtgctgtttcgctgtcgctcccctcacggggagcgtggattgaaatacccttaatccggatccgttgtatccctggcttggtcgctcccctcacggggagcgtggattgaaattcctcccacagcaccgccgtcccctccagcatgtgtcgctctccgcgaggggagcgtggattgaaataaagcggacggccacaccgtccacgactttgacgtcgctctccgcgaggggagcgtggattgaaatatcctccaccacctcatagcccatcaggcgggcggtcgctctccgcgaggggagcgtggattgaaatagctccgtctccagacggtgcaccagagcggagagtcgctccccttacggggagcgtggattgaaatcccggcggctccggaaggggcatccaccacaagagtcgctccccttacggggagcgtggattgaaattttaccgggaactcgctttgatggcgcaggacccgtcgctccccttacggggagcgtggattgaaatttcacggcggcgtcaatggcggcctgctgctcttgtcgctccccttacggggagcgtggattgaaatccgagccggacgaagcgttggatgtgaggtgatcgtcgctcaccgtgaggggagcgcggatggaaattcaatgtccgcagacaggatctgcttggcgctgagaaaatccgcatgattctcatgcagagggagcacaaggtcaacacaagatttgtggctgatatctatgcgtgagatggggttgatctgtgtccgaagtacttcaaaatcggagggactatgcttctgaatcagagttcaagaacaggatcgactcatatattgaattccgcaatacaacatggccttatcgcacattaaaaaattggactccatgccagatggaggaagactaccaaacgtagtggtgccaatcctaagaggttggcatataggggttcagatttcggaaatcttctgttttgtaaatcgatttcaagttttttgtgttttcatgtcccatttctattgcagatatgaaaatggctgaaaaccttgctgtgtcaaggttttcagccataaaacacccccacctaatccgtcagtctcatacaaactattcagattaggcggggggcgttcaaatcattgaagtgtagtagcccacaaaatctatatcccatctatttgttttcatctgcactagcttttcttatcttaactagatcgcttaatcaacagctgcctagctgaaaggatgctatataatgtcttctcgtagcaaaaatccgagaggagaccctctgtttacaagaaagtccaagacatttaaaaccttgtgcttacgcagggcatccgatttgaagaggtacagccgcttttgaacataacggtacatatactcttccatatagtagatagtgtttgtgggaagagcggtttgacgcagctgggggttgttggatataatgtcgctgagccattccacgccgtcttcaaagaacacttgggaaccgatgctgttcaatacccgaccgacagagtacaaaattgccggatgtgctcccgtcctatttactgccgttttataaaagaccgcacagtcctcccggagggagtgccaggttgtgatgccttctctccattcaggtcctgccaaaagatactccgtcaggacatttcctattccaaaactgatggcccgatcctcatccatctgttgctcgaattcgggggcccgttcgaaggcagagaagatgtagtttttcagcaaatcccaaaatccccaaaaggcgctatacctaggtttaatatcttcggcctggataacatcccgcaaaaagcgggtgaattccttgccgtatttcacgtgcttcaccaaatggtccagaaagatgctctgctgctccgcagataggcccagaacatagtcgccgagccactgtgtatatgcgtactctccttcgtagtcctgatagccgtctctgtccgtgtcctcaggtccgagcaatgtaccccagacccggtccccgatttttaatacgaaaacgaaggagccttctacattaccggacggaatcatccgctgcagggcaatcagttggtgaacctcaaggccgctcaaagggatgtcttctaaatcggagacctcctcttgaaacagcgcctggatttcttgactgtgctgctcaaaaaaggtccttgtagaaatgccgttgtagcaaaggacttgggagaaatatcggggtgcgagcaccgcataggtatgcattagctttcgggccacattgggggcggagggccaaaggatggaggccacactgttcagcgcttcattctgtttgccgttatacatcacaagggccagcagcatgaaaagtggagaagaccaatcggcgatgaagtcgtcactggaaaccagacttgccactgcggagataactccattcaactcatagggacctagatggcaatctcgattcaaaaagttcagacaggtcgccagaagtacctcggtgcaaaaggcaagcattgtctcatttatagccgtccgtcgctcccgtaaaaggactgcacaggcatttacggcactggaaatgtcgtgggagtccgcttctccctcctccagaatctgatagatctcatttaccactggctcgataccgccctcaaactgtgggtactgttgggcagcttcctgattgcctcgaagttttgcatctgcccaaagcattagcggtacatgccgcataaagtcctcataattgcgttgggcctgttcgctgagggctgtgagattttccggcatatctggcaccacagagatcatcactctgtcctgggacaccttctggctactaatctgacgccttcgaaggtcgctccgatagtacgcaaactgatatacctcctcccaggaatcgatgctctgggttgcctcgtcaaatgcggcatacagctgtgtctttctctcttccagctcattctcagacagaatgcctttttcaatctggtagtccaccaaaacttgttcaaattgcttttttcggaagggtagtgcattggtctccatccgctcatggtcgaaccagcgatgagatgccagcgttcctttcagaaaatcggcactgtgctccgcctgcagtcgggcgatgtcgaagacaaagacctccttggtcttcaacagaatacagctgatgggaaagagcttatctggataggcaatcaccacactcagtaccacggcagtaatggctgcgcttgcggatttcctcagcagatactcacagaactggcatatggttttctcctcggtaaactcggccaaatccagtagccatttttccagtgccatcaacacgctctccaacaacttgggtgctacatgagtacctcggtacatcttccacagtctgtcgctgcacacctgtcgctgtaccgtgccgtcagtgaaatggatttcaatctgagaacattcagaatactctgttgccaatttggaagaactgtagcagtttgtggcgtagttcatgatccgcaggatcgtgttcaacgcccggattggtgcctcctgtaataggaaaaacagcggagtttgaagggcgctttccgccttgtatttcatatccaagctgtgggacaggccgaaatagtactccatgctgtcatgagaatagtcattatgttctcgttgagaagagtcgcaccaataacgctccgcaagactgagtacctgctccggaattgcctggcaaactcttccgcattcataaacattggacaggctcttttgcaggagtaaatagttttccttgtaactatcatccgtctgtgtatctgtaaaggattggaagatgtcggtcagttcctgcttcagttccattgcggcagccaaaatcacatcggtaagggtgataaatcgcgagtctcgccgaagggtatagggataccgctcccttttccatatctcacttttcaaatagagggcaatcctccccgccagtcccgttgtctctcctgtttcatatttcgctgtccatgttttcaatgtattagtgacgatgtccagattttgggctgtccaaggaatcaggccacggttattataaatatattgaaagaccgtaaaccaagcccgtcctacagggcaggtgaagcgatacttgttccctgttggcgtggacagtttctttaacagttcccggtcgatgtcacggcaggcggtgttcagtagaaagaccatgcgggtgaacaaagagtatcgttcctgactcagaatggggtcgattgcccggaaacagtccacctgatcagactgcatcagtgcgatcagcgtctcatccttccaagcctgatccagtccgctttggagcatagagatcaaaaaatctgcatagcgacctccaccgctagcaaaaacggattccagccagatgcgatacagcttcctggctcgtagagataggccgaacccctctagaaccttctcggcctctattccctcctggtaccgctgggtcaaaatgtgttttataatcagctcctcatacacatcgtgactcatcatccaccgacgtggagagttgtcgtaaacggcgataattccgctatcctccagcgcggtcagcgccatatagtcatcgttggcactgcttatgtaaatggtggatccccgttgcagcatagagaacacgatgtgcgttaccatctcctctcgtcggacggggaggttttctgcgcgacggtggctgtcacagatgacctccttccagacctgctgcagaaacagctcctcagaggataccaaatccaagccagccggatctagctttaagtacagctttaaatagaagaaatccttcaggaggcttcgaagattctggttttggggaagtgggaagtgatactgctctgagatcgcttctagcacctcatcagctatgctctccacccgaaactcgtcataagcgatgtctttgaggagaatattgcaaaagctgtccttgtatacggtacggatggtgaagatcatcttccagccgtggtcaatgaatttatggacaagggcagcaaatacctgtgggctattaagtgcggagaacttctcagcggattcaattacacagacctttcgcttctcttgactgtagagggtaaataagtcttccagttggtagtttccatacttgcgtaaaaacagactttcttcctccacatccaagtcggtggaagagaacaagaagcaggcaaactcatcgccctgctcctgccgccgagaaatgagatccttcactacgccagatttacccgtccctgcgtcaccatatatgatacagacagctttttccgactcccatagtacatcgagcttctgcatatcataatagattttgatccgctcaccctggcacggaatctccgactgaatattggaacggatggagtcactccggttttggatctgctcaacccactgggaaagacccggcatagggttaaaatataaatctcttactgtgggtagtgccaaaagtatctgctcgatatggcttggcccccgccattcaacagtgatgccaaggctttcgccgtgtgtttcgatattctcttgatatatgggcttctgggtatgagggcgcttgctgacagacatttccttattaatataaaaaataatccggctgattcctgcatatttctgctttgcatccgcaatagcatttttgaaatccacttctttagatgaaatccgagtggaagcatcatagtatttcgcttgaaatccggtcaaaaggccatccggagccatcacgggctgtgtttcgatatatggttgattgaagtaccggaaaataccgtgcgaaagccccatctcgtggcagaacagcgtggtgacaaggccctcaaaggcagccctgggattctgagaaaacttggactcaaaaaccttccagtcaacggggatattcgtcatgtatagccctccctgcggtgccgaatataacgttattacaatttcattatggcataattgtggtagatttacaatgctactctcatagagacatgaatcagatttctgttaatggtatatgcggtgtagtacaattcataatccaaaatagggtagttcctttcatgtgatatgctaattcatatcacatgaaaggagcaaacaccatgacctacacagatcaagagaaaaccgctatcatcacacagtacagacagggcaggccaatccagcaattatgtacagaatgcggcgtctgcgcacggacgatctaccgctgggcgaagatatactgcccagtggttccggacgaaaaacgcacctataccgtcaaagagtatgatgcacttcttcgcagagttgccaaattagaaaacatggtcgctattttgcaaactgtcggctgcacggtccatgctccattgaaggagcggttaggagaactggagttgttatacggccaatacgacgtacacactctttgtgaagctatgaatgtctcccgcggaaccttctataaccatattctccgaaataagcggagcaatgcttggttccaaaaacgcagagaggaatattgcggattgatccgtgaagtatttgatgagtatcgtcaggtgctgggtgctgaaaagatccgcactattcttgttcaacgaggtcatcaggttagcccagaatatgtggcaaagttgatgaaggagatggggctgaccagcatccgcagtactgcgaagcaggattacatgaaacttcatgagccagaaaagaaacggaatgtcctgcgtcaacagttccaggcggacaggctcaatcaaatctgggtcagtgatgttacctgctttaaactgggggagctttatctctatacctgcgtaattctagacctgttttcacgcagggttgttgcctataaagtgtccaggaagaatagcacccagttgattacctccacatttaaggacgcatgggagcagagagctcccgataccggcctcatttttcacagtgaccgtggggctcaatatacctcacatcggttccgacaactgcttcatgagcgcgcagtggtgcaatctttctccaattcgaggaaacctcatggcaacgctgttgcggagtctttcttcgccaccctaaagaaggaagatctgtatcggaaggattacacctcagaggcggctttcaagcgtggccttgcctcctatatcgagttttacagcacccagcgcccacatcgtaccttgaaaaatctgacgccatgccaggttgaagatgcgttcatgagtgacaaatcatgaatccgtatcccagtgacacagctggggggcagattccatcgattgcgcgttttgcgtcttgatttcgccctgtttgcatttgtttggtgacatagtgccctctataataggaacgccagaaaccattgtggcacaatggtttctggcataaaatgaccctacctattctgaacattgacatctttttgttcagatcaggtagggtcattcaccggatttaccccttcatcagacggttctatcgcagagaataactcagaaattgcgccgcataaacaaagaaataagcgcgatgacaaagaaacagcaggctgacttggatgatagccagcctgctgaacgaagacgtttattcgatgttttgcctttcggcagcaatacgtgttcttttgcctgagaatgcaatgccgatttttataattgacgtaacattcattgcctgcaaatcaacgctgtatgcacggtcgttaatctgttgcaaggcaacattagcaaggtcttcaagctgtgcttcagagcggccttttccagcctttaattcaatcagaataccaggaagccgcttattcaaaggaagcatctgaatatcaaatcgtccatcaccagcttcgcgattggaggtaatgcgatagctgttgtccatcacagcgcacatacccaatatcagaccatggtaaaatgtttcgtcggcagcatcgtggaaacttattgtttggagcagaaacttctccaaagttttttgcagtgagtcgctatctaccttgtagatagcttcctgaatagcaatagcaacggaacgaggaataatattctcaagctgagagaggacctccttgctgtagacgaaagaaatctctttgttgggcagagctacttcgcacatataatcctcgccgtaagactggtcgcagctcacagccttcaaataacctgccaccagcaggaagctgtaaacagaggacggatcattctgaatctgcggataaatgacgccagtgtcaatgtgcgtaacgaaggattcgcccttcatcaacagctccagacgctccataatatccggcgttgcagaagccagcacctcgcggatgatgtcattgcttccggtagactgccagaacgctttgggacggcagttattattgaagtatccaataacagaccagggattaaaaatctcggtattgccgaaaagataaccatcataccaatcgcagagctcctgatatttatcagaagcatgatagtagtccgccatctcatgtacttcgcttgaagtgaagccgaaatattcactgtagcgctcgtctaaaatcgagttgatcttcaggttgttcaggccgctgaagatactttccttggcaacacgcaggatgccggtcaggaaaccatagctcagatgcggattgtccttcagaccaccggagaacaggtttcgcatgaacccgatgatcgtgtcgtagaagccgctcacatggccctgctgaatgggagtatcatattcgtcaatgatgacgataggtgcgacattgtggtgcttatggaggagcagcgtcagtgtccgcagggacatttgatattccacttcgtcagcagcttctgttgcaagaagggagtattcctctttttcgtaatcactaagtgcggagctggatgccaactcgtcgtgacggcggaattcctgtgcgatcagcttttggagcgtctgataggtttcttcccaagaggtgtatttaacatccttaaaggacaggaagatcacagggtactttctatgatgggcaagataggatcctccgcaggaccagattttcttatctctgaagtaaacggaagtgtcctcggtcgtcttttcgaagaaagtgcggagcatatccatgttaagcgtcttgccaaagcgtctggggcgggtaaacagagatactttggggcgctcgtccagaaactctttgatcattaaggtcttgtctacatagtagtagcttttgcaggcgtcccggtaatcagatacgccaatgggcaacggcttgcgcgcagatgatactgcgggctccaccgcactccgatgaccacgcttatccatcggcttttgagcgctgtccgggataaaccactgcctgccctccttatacgcgccggaaatgcgtccggctttgcaaagtgcattgacccgccgttcggtaatcccccaagcggcagccgcttctttgatcgtcatattggaacacctccattgcagttcgtcaagaatattataaccacgcttccgaataaaatcaactatattattccgaataatgtcggtgttattcggaacggtagttttcctgcaaatattccgttctttccggtagctatttcctgctttctgtgatattgttcgtttgccaaaaggaggcgacgatatgcagaaagaaaataccatgacagtcgggcggtggtgcggccggtggttcatcaccaaccgccataaatggaacggcaacaccgagggcgggtaccgcaatctgatttacagccacatcatccccggcatcggaagtgtggcgctctctgacctgacagagcagaccatcaccgatttctatgagacgctacggagtcagggactcagcgccagaagcgtctggtgcgtccacctgcttctgcggcggtgcatggacgaagcggcacaggaccagcttattccctacaacccggtgcggctctgccaggagcccaaggcagaggaatacaaaacagcccctttgcgattggggcagctccagcgttacctgaacgcagcggagcagctcggcgtacttcccgtcatctatacaggactatcaagcggcctgcggcaatgtgaactgatcaccttgtcgtgggccgattttcatatccgctgcaggtacatcctcaaaggccaacggttgctgacgctcaatgagaaagcggcgtatctcctgacgcggatatcagaaaccagttcatcatatgtgttccagaaccctaagaccggagtaccctacaagctccacgagttctactacttacacaagaagatcctgaaacaggccaggctcccgtgggtggcctttcgggatctgcagcgccagtgcatggaggtgggaatatgacacttcaggaatacatcagcttctggcaggaaacctatgacaagcatcagagcaggccgactacctatgcggcacacaactatgtattcaagaaccatattctccccggtttgggtgatataccgctctctgaattgacatcggagatggttggagaatttctggaggaacggaagcgcttcggcaatcatcgaaccggcagttctggcttgggagaagaaaccatgcggcacatccaccgcctgcttcagcaatgcttggatcaagccatacgggacggtctcctaacagagaatcccgccaaggcattccgctaccgcaagtccacaacggtgaaagcgaatatcatgacgcctctggaaacggaggactatctggacgctgccgagcggctgggctacctgcccatgttcatgctggcgctgacgacaggcctacgccaaggcgagctaatcgccctgaaatggagcgaccttgatatcgaaaatcggacgctgaccatcgcagaaaaccgtgccgtggtacggcgagagctggtggagtacggcagtcagacaaggacgatagcactgacaccagaggtaatcgacctcctaatcagggaacacgacaagcacccaagcagtccgctcatgtttatgcacccggccacgctgaaaccttactcgccgcagatggtgcgccggatgcacgatgagatcataaaggaagcgggcatcgaccatatcaggtatgtggatctccgccatacctgcgccatcctcgctctgaagaacggcatggataccaaggaactggcgcagatgcttggacactaccgccccacgatcaccaggcagaactatgaaccctatctgccccacaaggtacaaaaggacgaagatataccaaatgaggccacccagagcgaactgcaacaggcggcaaatattctggataatcttctgaagttctaatagctattccgcaaaaggtgtggtatatgtctgtgtcacaaggaggcgaagcccatgaaatacaagctgatcaaagaactatatgactgcttctacactccgccggagctttcggtaccccggcaagaaatagaggactgccacaaagctttgattgaggtgctggagaaacccgaacgcaggctggtactccagatcatcgatgccaaggaccgcattgccgaagacacttccatcgacagcttcatctccggatttgagctggcgtggcagctctctatggaactgaacaactataaaaacgagcgcttggtctcctgccgaactgggagactgggcgctcgtttcacacgcaaagaggaggagccaaaatgaaaaagcgtatcatcatcaccgtagcatttaccgcctgtatggccctgtgtgccgccgtgtggccgcaggccgaaacggtcggggaaacacccgcaccgcaccaaacacctgccgtaagcgccccagaagcgaccgttgtggaaatcaaaacagaagccgaaacggcactttcgtcagagaaagaaaaggctgtgattccgcagccggaacagacccaggaggccgtcgcagaaccgaagtcagcacctgcagaaacacccgcagtccagctcgccccggagccagtacctgtcccggaagcgtcttatggtctcaccccggagcgagctgcagaaccgcccgtagctaaaacaaccattgaacctccgtctggcgacatggtctatgtccccggctttggctggatacaaagcaaaggccccaaccatgtcgagtatgccgaggatatgtacgagaacggcaacaaaatcggcatcatgggatgacctcaaaaactgcgccgcataaacaatgaaaaagccaccttgaaaatcggcgataaaaaatcggtgataaatgtcggcgacaaacgtaataaaccaatagtccgaacctatggcaatcaatagatgtagaatttttgctgaaaagtatacgggcacacaatgatatagcaagcatcaacgaatagcggaaataatacgaaatatgttcaaaatggttgaaaaagacgtaaacactcagtataatatagaaatgaatctgcggaaacatacgaagacgaggtgtgccaaatatgtctaattcaatcaacgaaaactatattagtatcgaagatgcagcgttgtttcttaatattaaaccagtcactttacgcaaatggataaaagataaaaatgtgcccgctcacaaaatcggtaagcagtggaagttcaaacgttctgagctggaagaatgggtaaaaagcggaaagagcgctatggagtaatttcgctgatttcgtaggaacacttagggaaggaatatatataatgtcggttaatataaaatgtgttgacttgttttgcggctgtggcggtatgtcacttggctttcagaaagctggattcaacatcgtcgcaggtattgataactggaaatccgcgattcgagtatatggaatgaatttcaatcatccgattatagagcaagacctattggatgtagatgaggcagttaaaataattgcggcatatgctcccgatttaattattggagggcctccgtgtcaggatttttcaacagcaggatatcaagacgaaagccgtggcagggctattttatcagtctgctattcacaaattgtcagcaaggtcaagccaaaatattttgtcatggaaaatgtcgcaacaattcgcaatacgacatctttccgtaatgctattgctaatttccatacagcaggctatggattaacacaaatggttctggatgctgcgtattgtggtgtaccgcaaacgcgaaaaaggatgtttgttgtaggaatgctcgatgctccagatagcttcttagatgaggagttgcgccgtaatttatctcagacacctatgagtattcatgattatcttggtgattcgcttgggataggctattatttccgagtcccgacaaattacagccgaaggggcgtgttcagcatttatgagccgtctatgacaatccgtggggttgatcgtccaattccgaaaggctataaagggcatcctaatgatccggtcccagtagaacaggtgcgttgcctgaccccgaaggaaagaagctacattcaaacatttccggagagcttccagtttgttggtggaaaatctgatgtcaattcaatgataggaaacgctgtcccggtcaatttagcgaagtatgttggctcggcccttatgaggtatataatgtctaacgaaagtagagataacaatgagggtaattgacttatttgcgggttgcggcggtatgtccttaggatttgaaaatgcaggatttgatattatcgcagcatttgacaattgggatgccgcaataaaaatatacgaaagtaacttttcccaccctatttacaaaaaggatttgagtaaagacgatatcatacagcagctttctgatatgcgccccgatgtaattatgggtggtcccccatgtcaggattattctatagcaggaaagcgagaactgggtaatcgtgcaaatcttacgataaggtttggagaaatcgtaatcgcagtaaaacctatgtgggtagtctttgaaaatgtttataatattgaacgcttttcgaccgtcaccacgctgaaacagatgttggtagatgctgggtatggtattaccacacgagttttagatgcaagccgctgcggcgtgccacaaaagcgtcataggttctttctaatcggtaagcttggcgaaaaaaatggctttcttgatgagacgcttgtgtccaacctgtcatgcaagcaaatgactgtacgagactaccttggtgatgccctaaacacagaattttactatatgcatccgagaagctaccatcgtcgggccgttttttcagtagatgaaccagctgcaacgattcgtggcattaacagaccgattccagataattacaaacgccatcatgctgataaggctgatatatgcgatggtgttcgtgccttaacgacacgcgagcgtggctatattcaaactttcccggatacttttgatttccctggtgcgaaaacagatgtcgaacttgcaataggcaatgctgttccaccagctttggccaagtatgtggcgaattgtataaagcagtactgtactgaataggaacagaaagaggtgtgtttatgtcgtatttcaacgaaatatctgattatgcaacatattctgggcatgaagcagattttcatttctcctataatgcaaacagtggcggcggtcaggcttttttaggtggtcggttttacgatgaaaatggtcacttgacttctccggaaactttaaacgggcgaatcgttgcgtttaaatatctcttccgaaccgagaatggtgaggaagtgtctgttgttattgatgatgaaaaagcaaaatatgaagttaaaccacgaggaaacggctcaacatcaatgaaacttggcatcgggaccgatcgcgtgtccccgagtaaagtggtgtcagcgtttatgatgttgcctcctacctgcggcgtgaaaacgccaagcaatttgcaattatccatattaagtgcaaataattattggcttcagtccatgtggcttgaatgtagcacagaaaccgaaacaccgactgaagctattttcatcgtgaaagattgcgtttttggcggtggcgtgagcaaggaaactacggatcgggcaggccgctattttaaattagacattgaaaagcggattgcggatattattgctttatctcacaaaacagatgcttttcgcgaagaaatcgcaatggcgattaagctctttgctgatatttatcttgggcatcgcgcattcaattatgaagagtgcaatcaggcaacgaaatcccttatggaattgcttgcgcaggattttccagatgtctactcaggtatcacagatccgttgtctgcaatgcatgacattgtgataaaacagagtcatgaaaatactgtcgatgcagaggacacctctgttgataacgaagccgcctttaaggattggctggcacgtctcccaaaagcaaacggtgagctatattctgaaaataccagaaaccagtatatcagtgcacttaaatctgttgcaaaccagtttgcagatactatcggcccttttacctctgtttttgagattgctgatgtggagacatttaagaaagttgcttctgccatcaaaggtcatgctacatatgaagagttcaaccgtagccgtggcaatggctccttatccgcaggcctcgatttgtatcgtcgttttttggaagaacggaatccaaatgatggggtagaatatctctctcctgcgtggttcagacttgccgctgaaaagtatgtccaagtggatacggagtcaaatgctctgtatcagcagtttcaaagtctgtatgccccggaaaaactacgtaccctctctgacgatgacctgttggggtatatttttctcggcgtaaatgatcgcagtctgtgcaatgcattagagttcgatgcccaatatacacagtttggcagcatcgctggtggcaccgcatacaaatacaatctgttctacagtagaaatgaagaaacctggaagacctccttcggtgaaggtgggcagcgttccgtgtctcaagaagaggctcttgaaattggcaagcaaatccgtgatgctctggtggccggtgcggatgttatcgcaaaccatgaaacacttgcgacggtcaacgactacaatgctctactgaatgagttgaacgctgtcattccgcagtatatcaccaaaatgtggttcttgaagtattaccacatgatgttccctcatatcctgcccaacttttacaatgaagcatggcagaaacacattctctgcaatttgaacattgttccttctgatgcgcaatttatccgtatgggacaaatcaatgcttttgtaaatgagtgtggtatctcaaacatcgtcttttcaaaaatcatttttgatagtataggatctccaaaaacattttatcgaattggaacaggcgacaatggtatctattttggcgagtggcgacagaataactacattgccatcggttggaacgaattaggcgacctctctgctgcataccaagaggatgctgatagcaaagcaataatcaccgatgcgttaaagagccagtggaattatgataacaggctggcctcgcgtaaatatggcgagattaatagtttctattcggctgcagccgataccacatacgcagttgcaatggcaggacagaagattcttgctatcggacttgtgactggcggttacttctttgatgaagaaaaagaatacggtcactgccgacctgttcgctggctcaaagtttttgaggaaggaaaaacacttcctttcgagggtgaaggtaagctgaccactttctatgaactgaaaaacagcgaaaatatatgctacttgtattctcttctgcatggtcgtgatgaaaccgctgtttctgtcacagaagaagaaaatgttgtagcgcaaatccgcccgatcagcttcgctacaggtctgagcagtgaccaaccccgtaaccgtattctctttggtgcccctggtactggtaagagttttacgctgaatcacgaaaaggatctgctgcttgcagatggtggtgagtacgagcgcgtgaccttccacccagattactcctacgctaattttgtcggtacatacaagccggtgccctgcaaggacagcgatggcaaggacgccattacttattcctatgtacccggtccgttcatgcgcacctatgtgaaagcccttcagaacagcagaactgatgcacccaagcctttcctgcttgtaatcgaggaaatcaatcgtgccaatgttgctgccgtgttcggtgacgtattccagttgcttgaccgtggtgatgacgaggttagtgaatatccgatccaggcatccgaggacatcaaaaagtatctggcagaagaactcggcggcaaccccgacgattacgctgaaattcgcatcccagacaatatgttcatctgggctaccatgaacagtgctgaccagggcgtattcccgatggataccgcttttaagcgcagatgggacttcacctatttgggcatcgatgacagtgaagccggaattgttggcaaaaaggttgtcctcggtcaaggcgattatcgccgtgttgtggagtggaatgctctccgcaaagccatcaacaatgagctgctcacttataaggtgaacgaggataaactgatgggcccgtatttcatctccaagaaaaatctgccggagggtgaaatgattgaccctgccgtctttacccgtatatttaagaacaaggtcattatgtacctgttcaatgatgccgcaaagcagaagcgcattactctgttcggtggctgcgatgagaaggcaaagaaccagtattccaagatttgcagagaatttgacaccaagggtgtttacattttctgcgaaggaatcagtagccagtttattgataatgtcccagaggatgatggagaatgatttcagtatttttacgagaacaaaaacgctatacccaggaagacctggttaaagagtttcgttgctccgaggaaaagactgtccgcattctgaaacgactgaaagaatatggcgttctgaaggccgtaaaagcaaatgacacacagaaggaccttaccgatttggtggacgaagacatcgaaatcgctgatgttgaggtcggtgaaaacgaatatctgtatgtgttcacttttgtgggtgttattacaattgagggtcgtgtgttgaaatgctatccgaaatatctgctcgatgccacggcccccaaagcagaactgaaacaagtgctgaaggttctggaaaagtacaattccaaggaacagatcattcgtatgtacaacgatacgagcgacagcagtgcatttaatatgttggctgttatgctgttcctcctccaggattatttcgagtatggtgcctacaccaacacgcaggacatcattgaatccaacgggtccggtgacattctttgggataagaccatcaacgaaactttcactctcttaagcaacaatcggccgtattacccggaattgctgaccatgaagcgtgtgaatgacgatttcgatttcttcaagcgtctacatgagtgtatcctcactcattgcacggaggaattgagagatgccgatctgttggatctgttcgatattatgggtgtcgatatttccgatgagcatatcgaggactttggtgacaaggagtatgtcctggagcgcattgtcaaagaacttaatgtccagttcaatacccggaaacagcttctgctgaaaacgctatatgcctatatagccaacagcagcgcactggacgatttggactgtttcagtatgttcggcacaaacagttttaacctggtgtgggaaaaagtctgtgcggaagtgatggacaaccaattgcagaaacctatcggtggactgcgattgcctatgccgttggccgagcaataccgtgatatgcggcataagaaactcattgacttgattgataaaccgcagtggtctgggaatgctccaaacggtgagttgtttataaagcaggccgaggatacgctcatcccagatcttatttccatcgttaatgccgatgggaactatcagtttattatttttgatgccaaatactataacatccaattggagcataacaaaaagttgcgtggtcagcccggtattgagtccatcaccaagcagtatttgtaccagttggcctatcagccgtttgtggaagcacatcagattggcacagtgcggaactgcttcctcatgccgacctcttctgctgaaatagtcgaaaaaggaactgtgtcccttgatatgttgagcaagttggggctacaggatattcagatacgccttcttcccgcgcaaacaatgtatcgccattatattgaaaacacaaagatggatatcagaacacttaatctataaaggagctcggcaactttacagttttgcaaacaatgcaaaatatttacaaactcctgatagatagttttggaatgaagtaggtggtggtgtaatgccttttgacattgttcgaaacgatattctgaatatgcaggtggacgccatcgtcaacattgccaatccagaacctatccttggctatgactgtgatactggcattcataaaaaagcaggcccagagatcctccaagcaaaaaaggttggatctatcggcgttgggcaggttgttaaaaatgagcgataaaagcaagcaataaaagatgacgataaaaagcgtcgacaaaaatgtgacggtaaaaactgacaataacaccacactgccgaaaggagctgggaccggcgagtctcagctccttttttcatactgactattcctttttctctgatccattcaggctggcccagtgctggcgcagcagccgttctacttctctgcgaagggaattttggaacatgacagccataaccaatgcgctaagcactgcagccacagactccagccagggatatgcggcccaaagctgttctccccagcaagcaagcggaacaccaacaagcagcataaacagcaaaataatgatgacaacgtcgggtctgccgtagccttcacgtcttttgattttggcccgtatctgtcgaagcgcacgggctcggatatcccggatgtttctggacgaacactgtttgtcctgtgcgacggattcagtggactcgccattgatgaccgtgcggaacaaaatctccctctgcagttcggtcagtgcatgcagggcgtcatagatttgggtgtccagatacatgaagggatcttcatcagaaccctctggcagatacttgcttcggtcaaaccaacgtctgtcattgtaaatcgcattgcgtacttcctccggcaggaacgcttccggattgtaagattggggctgctttatatccacatcctccagagtatccggtgctacacgcttgtgaaagttcgcctcgctgtagtagagcatatgctccagctccttccactcctctggatgctccttcacccattggtctgcggcagcggtagcttccgggtccatttcatgtatccagcgccagtcagaccgaagttctttgtacgactgagtatctttgaaggacatgagctcaccaccctttctgcgttcacaaaaaatttacgattccagaccttccgattttgcgaattttctctaagtaataatagaaggacaatttcacccgggtgaggttgcccctggttcggtacggcacggtatccgcgccgacgaatccacatgacctttgacagagcatctatgagagcatgagcgctctccgccatacggcgatccgctcggaaggtcattccatctctggccgtgttcccgggagcacggcctctttttattctaacacggaggaggcgaaaaagatagtttacagatgagggcaaaggaggaatgtggatcacacagcacacccgaaaaacaaaaaccgccgtgactgcggcaacagtccggcggctcggcgcacacacaggcacgcacaaatttactgataaaagtatatcaggtaaacagcagaaaagcaatgaaaatttttctgttccctgtgtgagcgtcatcggactctacgacaatacaggaggtatgaattgagtttcaacaaatggcccaagcgcagcgcagagaaaaactattttatggtaccaaacgagatattcagcgtcggtctggattttcgtgagatctccatctattcctatctgctccggtgcgagaatcgtaagacctaccagtgctaccccagttacaaaaccatcggtcatgcgatcggcatgagtgaaaatacagtggcaaagtatgtgcggcaactggaggagaaaggtctcatctacacggagccgacgatggtacgaagcaaagatggcagacccctgaacggaaatctgctctacaccatccgccctatctcaggtgtactcgaagcgttctatgagcggcagttccggcaggcagaggaggctgccgcccgctatcgtgtggcagaactcctcaaaaagtccaacgcacagggccgccagaacgccttgtgtgcgcctttccgggaggaagagagtcccagtcccaaccagggggttgaaaccggatgtgagccgttttcggagggatttgagaggacgaaagaaaaagcaggataaaggcatggcgtcgcaggcgtcgccgcagccgccacttctgcccgcagtgcgggcagtttcggacgcttgaagctggcgtctttgagagacaaaaaaagctccgatggcgtcagcttccccgaaaagccccgtgttgcagggtttttcaaggatgtcttacagcaaaaaggaggaattgaatgagtaaagaaaccagagagcgcattgcattccggatgcagccggaaaccagaagaaggatcgagcagtggtacgccgccgacaactgccagagcaaaaatgagttcatcgagaaagccgtgaacttctatgtggaccatctggagatacaggacaaccaaacgcttttgcctatggcgatccagtctgccattgacggcagactgagcagaatggaggactatatcgcccgcagagattttaccagatgcgtggagcaggacatgaccaacggcatcatcgcggaagcgttcgagatggatcaggatgatctgaagcgcaggcgggcacagagcgtccggaatgtgaagaccacaaacggtctcatctcgttggagaaatacgcacgctcccgtcaggagcaggactgggatgatgatgaatggcaagactgatcctcaagagcccttatatcaaaagcaccggaggagcctccggataccttcgctacatcgcaacgcgggagcgggtggagcttatcccggatgaccgtccgcccacacgaaagcaggagcagctcatcgccaaactggtcaaggacttcccggacagcaagacgctctacgagtacgaggactacctgacgaagcccacgaaagtcaacgcctctgcgttcatcacgctggcgctggaagccaactgggatgccatccacgagtcagaccagtacatgaagtacatcgccacccggcctcgtgccgagcgcatcggcgcacacggtctgttcggtgatgaggaaacggtctctctggagaaatccatggaggaattggagcgctacaccggaaacgtgtggacgcatatcatctctctcaagcgggaggatgcggtccggctcggcttcgataacgccgcggcgtggcaaaatctcattcgggcgcaccgcaacgacatcgcggcggcaatgaagataccgcccggtgacttccgatggtatgctgccttccacgacgagggcgagcacccgcatatccacctgatggcctggtccgcaaagccgggacaggcctatctttccaaagagggcatccgtcagatcaagtccaagctgaccaacgatatcttccgcaacgaaatgctccatctctacgaacagaagtcagagtccagagatgagctggtgcgccaagcgcggcgggcgatgctggaactggtgcgtaccatgcaggacagcgtatgtgaccacccggatgccgagcggctcatgctggagctggcggcgcagctcggaacagtcaagggcaagaaatcctacggctacctccccaaacggctgaagaatctggtggatgagatcgtggacgagatggaacggctcccagccgtgagcaagtgctatgaccagtggctactcctgcaaggcaaggtggctgcctactaccacgacaagccccaggagcgcatcccgctctcacagcaaaaggagttccggcagatcaagaatgcggtcattcaggaagcggagcgcctgcgcttgggtgagatcggcttcgaggagaagggtctcaatcagcaggacgagccggaggaataccgcaacgcctcctacgactactggacactgcgggatgagatccgggacgagagcctgaccatggaggagcgcggcgaagccgtctctgaaatggaaaagctggcggaaagcggcgatatgtacgcccagtacctgatgggaaagctctggcgggacggtcctctgctgatacccaactcggcgaatgcccggtactggtttgaacaggcggcggagcaggaacacattgtggcgcagtactctctggccaagctgtacctctccgatgatgtggaggtacgggatatccggcagggaatgaattggctgtacaccgccgcggtcaacggaagcagctacgccatgtatcggctggccaaggaactactcaaaggcgatttgatcaaacgaaatagtgatgccgcggtggagtggttcaccaggtcggcggagagaggaaatccctacgcccagtacatgctgggcaagctgtacctcaccggaaaggaactcccctgtgatgaggaacgagcaatccactggctgacccgatccgccgagcagggtaaccagtatgcccagtatctcctgaaccatctggaagaaaaccgccctccctctgcaatgctggcagtcacccggctgctccatcacatgagccgggtgttccgggataactccgttcccaagtcgcgccccggtggtatccaaatcgaccgtaagcggctgaagaagctgcaggagaagcgcatggccctgggccacaagctggatgaccatgaggagcagtggcccaatctgaccatgtaagaggcgcaaaaactgggccgcaaaacaaagaattaaatccttctgggcggaaggtagaaaggaactgaatgagaaaatccaaatacaattcttttgacgaactcccgctgatgctgaccgtggaggatgtgtcccatgtgctgggcatcggtctggcccacgcctacgaggtggcccaccgcagggatttccccaccatcacactgggaagccgcatcatcgttccccgtgacaaattcatggaatggatcgacgaacaggccgcgaaaaaatctgaaatattttagtagctattccaaaaactctgtggtatgtgtttgtgttaaaaaggagggatcataaatggcaaagaaacgagccaacggcgagggcagcatccgcaaaaagcccagcggccgctgggaaggcagatatacccagggcatcgacccagtcaccggcaaggccatccaggaaagcgtgtccgccaagacccaggcggagtgcaaagaaaagctggcgaaagccattcgggaaaaccggggcgtgccgctcaatcacacgggcgactacaccgcagcggagtggtgccgcctgtggtttgaaacttacaacaagcccaacatccgctacaacaccgccaagggctatgaagggatcattgaacaccacatcatcccggccatcggcgcgatcaaactcaaacagctctcgtccatccacatccagagaatgtataacgacctgaaagaaaacggcaggatgccccgtggggcgaaacagaatgacaaagccttgtccaacaccttcgtgcggcgtgtccatgcggtgctgcaggcggcgctgaagcaggcggtgaaagagcggctcatcccgtacaacccctgcgagaactgccgcatcccgcccaaggacaagaaagagatgaccatcctcccgccggagaagatcggcagatacctccaggaagcggagaagtacggcgtcctgcctatgttctatctggagttgtccagcggcctgcgccggggcgaactgctggcgctccagtggacagatttgaatgtaaaagagcgcattctgacggtgaataagcaggtcacccgcatggagggcgagctggatgtgacagaaccgaaaacgaaaaactctgtccgcaaggtggcgctgtcgcagcaggcggtcgacctgctggtacaggagcacgagcagcacccggacaaccccatcctgttcccgtcgccccgcacgggcggctactggagtccggacgccgtgtcgaggatcaaccggaagctgctgaaaaacgcaggcatcgaggagcacgtgcgctttcacgacctcagacacactttcgccacgatggcaatctccagcggtgtggatgtgaagaccctgtccagtatgctgggccattacagcgccgggttcactctggacacctatacgcatatcaccaacgatatgcagcgaggcgcggcagagaagatcggcggcttcatggaatcggccacggctaagccggaaccggaaccgcctgatccgccggaggagagccggtgcaaggtgataccttttgaaaaggtagtctaagtgagcaaagggattccctggatcacttttgttgtccagggaatccctttaggatgtattagaaaacactaattactaatatggagccttcagtaatcacttcgactatcttgaaattcctgcaatgcaacccaaaacggcgaaggttctttactgaaccatctcccatattgattttgcaaattctttgaacgaataagaatacacgcttttcttgcacgactaactgatacaaaacaaagccttcgggcttctgccagttttcttggagtgttatcatagtagctgggaaagctatccttttccatgcccggcaatatcacaacatcaaattcaagccctttggagctgtgcctggttgttaggacaacttgattttctgggataccaagccgtgttagaaacttaatcgttagctgcgtatcgtggcttcgtgctgtttcgagcaacttattgtaattatcaatctcgtcaggatatcgctctgaagcagtaaaagcagaaacaattcccacctttttgtcaagatagcataaccattccgatagattatccttataaaccttacttgcagttaaagtttgaaaaattgttcttttaagtaaaaagtaatcgtcttcactaatgatccgcttttgagaaataaacgatttccaagttgagcaaatttcatcaaatgagacggagcatttatccgaaacccactttgcacagttttgaatccagataataagatctgttaatctaaatgtttgacgagcaatatacgccggaatattttgtctggaacattcttgtgccaattctgttacttgtttattatttccgactaaaactgctatttcgtggtatggtatgccttctgtgtgaaatctggatatctgctcaataactctttcatattgttcatccatccctttggaacattcgatgaattccagtttggcgtggtagtcttggagctttccagaagcaatatatccccggctactttttagaacatattccgaggcatctactattgtttgtgaacttcgataattgtttttcaggtgaatgcaagaaacatcttggcgttggcttaattctataaggtaatcaggagctgctccttgaaaatcataaattgattgatctgcatccccaacagcaaaaactttaattcttgtaagatttaatagcgttaaaataagttcatgaagcggttttcccaaatcttgatactcatcgacaataatccaaggatacttagcctcaagtgctttgcgtacataggactcatttttaatgagttctacagattttttcaccatgctgataaaatcgagatactcgttttgtatcaagagttcttcaaaagagatggcagcctttagtgcaatatcatagctttctatcgcaacacgactaattccctttatattccttgtgcgctctttatctacatcaatgagctttggagttccctcataattctgagaattaaagagacgattcttttcagcttcagagataatccggataggcagtggtattttgtattgcggatatagggctgcgaaaggagtaataatttctgaaagacaaaaactgtgaactgtaccaagaaaaacatttttgcgcttttccaaccctaactttactaaccgacttttgaattctcggacagcctccgtactatatgttaaacatgcaaggccgcgtggtggataaatcatctcggctaatagttgcataactttcaaagtcaaaactgttgttttcccacttccaggtccagcaattacaactgtattatttacagctttatatgcagcaaactgcatgtcatcttcgcttatttcctgcaattttttctcaaaataagcattcaccacattcacctaacttttgcaacaatcgcatctattgcattcgatatatattctggaattatcgaggcagatatatgagtggctaaccgttgagcgaagcggcctttaccgattccactataagttgactctattttggaaaggcacttgttataccttccagaggaaagctctgcagagaagttatttttttgaacctggccaccatttgttagttgattaaaaatagaacatagaacatctcgatctggcccagtggcctttttgaagatatccacctcaagtgtgtattcaccaatataagtgccaaatgtttcaaagtatttgcgcttttcctcattattcaaatggatatactccggatcaacagagccttgatacattcgataaatacgatcaatcccatcaaagcccttgcccacatggtttgcatcttcaatatctccaaaatgctttttttcatcaactatatgataataatcaccatcagtgataataacataaggaataccaagtgcacctacgaaacgacaatacggttcaaaattcgtagaatttatgttacaaatcactacgccgagacgatcaaggtcgtatcctttggcttttgaaaaactgggaaccaaatattcttcggaaattccctccacaaaaataatacctttagcagtatagagttcgcctcgtttgacatcaatgtatcttgttaaatccgcataatcgtcctcagacaaatcaatgcctgctgttgtttttacctcggtaccatcttttgtcgtaattagatgaacaagagacgtaatgggtgcaactgaggatatatgtgttgagtgagttgtgattattacagaggtgttagttttgttcataatatggcgatagagaagccgttgataaattggatggagatgcgattcgggctcctcgacagcaagaatggtgatgccattcgctgttggaacaaaatccgaaaagaacgcatatagaccatcgtataatgtggcatcttgcagagccgcaagattcaaggcgtagtcatcggagctggcggatttttcataacttctttcaagtaaatgttcatgatcctgttttatcaattcacgatataaatcgccggataggaatgttttgatagtatcatcttcaatgagtagtagaatcaaagctacatagagaatattgttgattcccaaacttgtgttgcccgtttctcggctgttaattagaggtcgtagggcataaagaagtttagttgcatcgatattcattgttttcagagaaatactgaactcatctgcactaaaggacaccatgtcattcaataaccgttgcagcctattctctaaatcatttacttgaccaatttgtaaagtatctgcacctttttcatcaagagcctttgatatctctaaaagtacactcttgctgacagaatatttttgcttaataatttgtgttagaggagaagttcgggaacttttcatttctgcctcaacatcacggatggcttttatcacacgaatattaagcatttttcgatcttcatatgtaaaagccctgctttcatcgtttcccttatagatgatgtagctatagtctggttttgtagcatcttttttaaaaaacttgtagctgatttttaatgtttctttgccttctaccattaccgacgcatcagccaactgggcaagcaaattcttattatcctcgaaatttgcgagatagatctcaatcaatatataatgcccattatccatagggttttctataccatcccaaaaatcggattcttcaagcattctgtctttttcagaaagcgttggatcaagaatcagttgaagtgcgtaaagaagattacttttgccgactgcgttttcgccaattaatacctgcttttcgccaagagaaaaatctgctgaatggaagtttctaaagttttcgatatgaactcgacaaatatacggttgagttttcatccggtttaccttctttcgcacgatcttccagtttcttgttccagcggaagtatcaatgatatactctttgctacatgtagtgcagtgaagatatacactatgctctctaaatcctggaatgttgtcatgctcctcgataattgttccttttccacatggacattcgtattcataatattctgtgtcgccagcgcctgcaccgtatcctgaatgctgttcacacttagcaataattcttttagtccgcatatacatctgcccctttttgcaaaaaagccgcgtgggagtacacccacacggcggccttggtgatacaaaggctcaccgtaaaataattataagggataatgccgaaaaattcaagtttccgtcgtatctgcggcgaaaataccgagttgcacccgttagggattggttagggatttagcggtttttgccactctaccatacaaggctacaacgacaattttacctctctgaccacagttgaaatgtggtcaagtgaaactcaaaaacaaacttttaacgcagaaaaaccgcctaaaaaggcggtttttcaaagaaaggtggtcggagtgcagggactcgaaccctgggcctcctgctcccaaagcaggcgcgctaccaactgcgcaacaccccgttatgaagttaggcgatccggctgggcgtattctcccaaaccacccgcgctaccaactgcgctaatcccggatattcgatttttctgcatgatactatgcggagaaggaaaaagcaagtttttcgtgtctgtgggcagtgctgtggtcaaggccggttttgcgggggatcttcaggcgggggatttccgccacaggctactgtcccaaggacttccgggctttcacttttgggggaatggatagaccgtctatcctcccaaagcaggcgcgctaccaactgcgctacacccggatatgaagttgtggggtggcccgggcgtattctcccaaaagaggttctcagcattttttatagttgtttatagtaatttatcatcatttctgctccaacccagttactttctagcgatcttgtttccactgtttccgtgtattccagctctgtctgtggtcttgcatgtggtcagcggaaaagtttcggccagaatccctgccccacagtgacaccctaggtggtacaatttacctcaaagtttgaaaaatggtacctctatctcgaaaaacatacaagacttttttgagagaaaaccgatcaatttttgtgtcgctatatcaaagaaaacatctgtcaagaactccccccaaaaatccgccgtagtctctgaggctacggcggattttcttgaatgctcaattgctacaggtgcccggattttataatggccctaaaagaggttgtcattcaccccatctcttttttgccgatgatatttcaggtattggagatgcgcttgacacaaccggaatattcctataaagttaatcttgacaaagctggctaccaaaaaataacaggaccatactctttttgattgcttgctgtagaaacaacccagagaacagtcctacaaaaagttttttcacgaataagcctgatgctttagatactttagccgttctctctgcctgaatgggaggcctcaaaatgaatctttttgatttactcaatccgagaatgttccggccgctgacagggcgaaatcagcgcatttatgctgacttgctgatgctgatctgggacagatgcagcacatcccaggactacagcatcgggaaaggtgctcttacagaactggcagagacctatatggaaggactgggcacgatcctgccgcttgatgaagaggattccccgggcgaatcagccacggatgccaggagccaaggattgctgtttgtgcgccgtttacgggacgcagggtgggtggaagatctggagggcggatatgaggaggaaaaccgcacggccctgtctgccctggctgtccgtctgctgcaactttttgatgaactgctccatcccaagactgtcacatacagcggaaagcttttaaaggcttatcgattgctccaggacatggagcacgaaaaaagcccttatgaaaatgtgctcaaagaggtctccgctgacatggcggacctgaacacctctctgcggcagctcaatgcatctatcgggagctacatcgaccagctgactcggaatcggacccctcaggaagtcttggacctatttcagcaatatgaggacgaagtcgtggtggcggcctaccaccgttttaaaaccagtgacaatctgttccaatataggacagagatcctagagggcttggatgcctgcaacgggcagtatgctgaggcattggctgcggattactgcagagtggagcgggtcagcgagtcggaagccgccattgcagtacgaaggctggttcagaaagtgcgggatgatctggagattatgcgggatctgctctcggagatcgatcgcaaccatgtgacctaccggaagcgggctgtgcagcgggcacagttcatgctgctctccgacggctccgctcaaggaaaaatcagcgatctgctgcggtattacgcccaaaccattcagcgcccggaagagctgttcgagccagacgagagccccttgagccgccattggaaattctatcccacagagatcctaggcaggaactttctcaagccagccgttaacagccgaaaacccactcctatcgagcaggcacctccggaaccgcccatatccgaggaggaactccagcgccagcaggaactgctgctggaatatgtccgccaggcggtcactctggaaaatgtaaatcgttttgccggccaggtgctgaaccaccgagagacggtttccgctctggaactggcttccacgcaaagtcaggaatttatcaaaatcatcggacttcacacatactcacaatcccccgaccgcaattatgagatctccgaacaggaggaatgggtctcctgcggtgggttccgattccagcagttctggatacgcaggcgaagctgaaagagaggtttctatggacgtaagagaggtcgccaactatttgctcaaccactgctttcttccgtcgcaggcggaagacctgctggaaaagcattactatgcggtcaatcacttggaggagctgcgccggatcttcaagccccttggctatacggttgtctaccattccgcgcctctgaaggtgatcgcactggtcagcgagtatgagggcaaccaagcgaagctgaataaatatgagagcatcctgctgttaattttccggctactgtatttgcaaaagcgggagaagctctctctggatggagcgcatgtcgtcgccacagtgggagagatccaggaggagtatcaaaagctgggtcttccccgcaagctggaccggatcacgctggaagccatcctgcggaccctcaagacctacaatctggcaaagccgctggaccgtctcaccgaggaagaagccaaaatcgagatctatcccactgttattctggcgttgccagacaatgtcctgaagtcatccagggatgagacggcagcggcactggacaaataccgcaaagccggtgaggaggatgatgtatgattgcactgtgccgcctgcggctgatcaactggcataattttgtcaacgaccttctgaatatccagcagatcacctatctgatcggcgtcaacggtgtgggcaagaccacgatcctggacgccctgcggtattgcctcaccacgagcaaaagcttcaacgccctgggcaaccgcaagagcaagcgaacactgctgggctcggtacacggcaaacagcgggatcaggacggagaccgtccccggtacagccgcaaggggcatactgtatcctatgtcggcgccgaatttcgggatgataccgcagcccctgggaaggacacctttgtcattacggtccgggtggaatctgagaaacctgacgaggacatgcgtcacgtacagcagcgctggtacatctctccccggggcgtcatgctggaggacctccccttcctgggccccgactatattcccacaaagcgggaacagttctgcccgaaaaatgggaaaatgcgggataccgacaatcaaaagctggcaaaagacctgatctgccgcgcgctggggattggagcagcagactccccgttggggaagaaattctgtgcggtatttcccatgggtaccgggatggacgacattgaggacttccgggaattcatctatcactacatcctcccccagccggaaattgacccccaagcactgcagcaggagcagatcgaattggatcatctgaacgacgtgctgctccaggcaaaggagcgggcgcagctgctgacggagatcggtaccctgggtgaaactgcccgttccaagcagcgggactgcagagtgaaccaggggtttgttctatatgccagccaacaggcggcagagggggcagaggagcagatcctctctgccatctgcgacggaaaccgggagatcgaccgtctgcaagaagagctgcagtatcagaaggagcggacggagcaggcccaccagcggtggatggatgccctgcgggaaaaccagaacagcccggaacgccagcagctgcaggtcttcgaggatctggtaaaagaccgtgaaaaagactacacggaggcccgaaaagccctctcctctctacaaaacgccaaacaggagctggaagccctcaatcgaaagctgtccgactgcagacgagcacttccggccgaacagatgccggatgccattgagcagctgccggagcagcggcagacggagcagctcaccgccatggaacaattgcttcgggagcgggaagattccctggatcaggaggaatttcaggtccgaagcgatctccaacagctgaaggagcggcaaaaagcccttcaggcgaaaattgaaacgctggaaaagggccagttggtctatccggatcaggaccgggcaaaacgggtctgccaggccatcaaccgggagttggcccagcagggtatggaggccgatgcccgcattctctgcgagatcctgacggtacaagagcccgactggcaggcgtgtatcgaagcctgtctgggaaaccgccgcttcgacattttcgtctccccccggcattaccgtaccgccaaacgggtatttgagcatctgaaagccgaggtcggacaggtcagccttctggacagtcctgctctggagcgggatggcgaaaaagacgccgcctccccgcaactcagtactctcgccgccaaagtcaccagtgaaaactggctggccaaatactatgtgcagaacctgctggggcaaatcgtctgctgcgatacgtcggaggcgctggaagcgtatccccagagcgccacaaaagatcttctgcggcactatccttatcggttggcacgtctgcgaacgcccgtgctgtatatcggtatggaagcccgcaagcagcagctgaaagctgcctgggaggagttttcagctttgcgcggacagctgaccgagtgcaccgcccaggcacagtccctgcgggatattctggagcaatgccgccgcgttctgcacagcagcgttctggaggatctgcgcaaaaactggggcagcgtccagcggcaccaagccagttggcaggcgctggagcaggcacggcaggaatacgagatgtggaaggaaaatcccattctccaggcaaagatcaccgccgaacatctctgccaggaagaatggacgcggcaggatcaaaagcgggtggaaatcgaagccaccctccgctcccaaacgaataaagtccaggaaaaacaagggatgcaggagcaggccagccgggaggcggaagacgccagagcaggctggctggcgttttgccagcaggaacccttgctgcagacagaggtagagaaaaaatatcaggacgcagcccgcagccgtcccccggacaagatcgtccaataccaaacgaattatcaaaatcaggtggataaagcattggacgaatggctgcgggatcagctgatccccaggcagcgggagtataacaccatctacacctgtgattatcctctggggctggatggcatcgagaccttccgggaacagcaggaacggctggttcatgtagatctggaacggtactctaccagtctgcaccaggcacaagaacggtgccgccagcgcttccgtgaagacattctttatcggatgaaggacgatatctataacgccaagcggcaattccgggaactcaaccacacaatggaaaacctgcagtacggtgaggaggtctatcagttcgttgtccaggccagcgccgatcccgaacgccgggcattttatgatgtaatcatgcaggacagcaaccggcggatccagggggacggcagtatcgaagattttctggcccgcaatgacccggcctacgaaacgcaggtggacgaattgatggagcggatcctagcagagctgaaagccaatgcccagcgccgccaagagggaaagcatctggccacagagctgtctcgctatgtggactaccggtactacctggaatatgatattgagtgccgcaaccagatcaccggcggcgtgacccgcctctctgcggtcagtcaggacagcagcggcggagagaatcaggcgccgttctatattgcaatctgtgcatccctgctgcagatctacgacaaatgcgagaacagcattcgcctggcactgctggacgaggcgttcagccgcatgaccagcgaccgcatccgccccatgatgcagatgctgcgcaaaatgcagctacagacggtactgatcaccacagtggaaaaggcctcggccatccagccctactgtgacaccacctgttccattatcaaaagcggtacgcgcaatgctgtccgcccattttatcaggatgtgagggaatgatggactacacccacgaaattctcacggcgatggtggatcgctatgaacgcaggaaaggaacttctgcccagaacggtaagccccagcgggcggtaacctttgatctcgcaaagtattatcccatataccgggaccacctgagcgaggaggagcaggccattgacgatgcggtgacgcgcctttccagttggcagatggttgccgccccccgcagtgcccagggatactacaccaagattactctgcggctggaccacattcaggaaatctatgaatttttagggcggaaaccagcccaggaaacccggcaggagcaactgcagcttctattggatgcccagagacaaaacccggatactctctccagccgcttcgccggagagctgatggccgcactgcaggcaggacgttcaccgggatacggccttcaggggaatgttgagaaactacgggatgttctgctggctctggaaaaaatcgggcagttaaacaaagagacctatgtgcgcaacttttccgaggccgtattccatgactccaagcactttcactctatttccgggattatccgcagtattctctccgatttgacagaccagccggtagaaaagaagcagatcctggaatattacaatcttttggaaaatccaacctacctctatttgaaaggaggctggatattggagtttccggactcatgtatccgtgttactgatcttccaggtggtatcggtttgacctctgacggtttgagtgccatacggtctgtccttttggagccccggacagtcattaccgtagaaaacctcactacctatcacgacattccctcagacgatcgagccgttttatatctgggtggtttcccaaattccgcacgggcaagttttcttcgtatggtttacgcttccaaaccggatgctgtttatctgcattatggagatctggatccatacggtcttttgatactggaaaacctgaaacaaaaaaccggaattccatttgccgcttcaggaatggatcttgctaccctgcaagcttgtttccaggcaggacattaccgtccgctgaccgcagaagatcggaaagtcatgcagtcacctatgctctgtgcctaccgggaaatatttgccttcatgcaggcacataactgtaaagcggagcaggaatctctctctgcaatgaaattataactgccgccctggtatccataggtcggaggcaacttgcaaggcagaccgttctctcttgttgtacggtttattctgatactattatttttttctaatcgcttttaatgagttctagtcccaaagaggtttccggaattttttataggcgtttatattgctttatagtcatttccgcttcaaatcagttactttccatcgctcttgtttccgctgtttccgtgtattccagctctgtctgtggtcttacatgtggtcagcggaaaagtttcggccagaatccatgacccacggtgatactctaggcggtacagtttacctcaaagtttgaaaaaatggtacctctgtcttgaaaaacatacaagagatctggacgcacataaagttccacccgaagagacaaattacagcgtcattgccaaggggccaaggtgacccggcatacggtatccaaaccctatgagatgattcaaaagatgccgggaatccaggaaaccgctttcccttactttgctgaattgccaggcagaaccgcgtatgatatgatggcaacagaaagcgaggaggtgctgtcatgcccgtatggatgtcactcaaatgccctttgcaaagctctatcctctgctggtggcaaaagcggagcggaaaggccgcacgcgagaagaggtggaccaggtcacaacctggctcaccggctacaccgccggagacatcgcccgtctggaacagtccacggtcagttacggtgacttctttctgaacgctccggttctaaaacccaatcgcacaattcaacatccggtcaatggtggaggtgctcctctccgtttttccggtgaccgtcttgatgccgtgagattccagatactttttatcttccggacgccgtttccctggatgtagaggtcaaaaatctttcggatgatctcggcctcctccagtacgatctgcagcactccattcggccccttagtatagctcagaaactgtatgtaattcaaaatggttttcccgctccgcatgcgattctgaatgccaaacttaatgttctcgctgcgagtttggctctccacttgtgcagaggcagcatacagatcgatcacgctgtctggcggcttcatggtaaagatacctcctaactcaatgtaaattcctacgttcatttatttcagctttctgattgtgctaatagcttcccgggcatctcttccaaagcggctgagcgatttgacaaggatcaaatggatcttccctctccggcagcctctcaggatcttccgatagcctgagcggtttttcgtgtgcaatctcgacgcttggtccgcgcaaacagccacgaatcgccacaagggattactctgaatgaaagctgtataatacgcgatctggttttccaggcttgaattttgttcctcctgattcgtgctggtacggcaataggttgccccccgcaactgctgattccaaatagggtggtcctcctgcgtctgcgggatctcaatcacatgttgaaacataagaacccctccatgatacatactgtcgatcagtttatcatggaggggtagaaaatgaaaaagctacatttcagttcaaggaactaaaatatagcttttaacatgtattgtgcgactattatagatgtcgcttgagagcctttattcattagatctaaaaaaatagatctaaaaagtataatggtagcattagttattatttatttcatagagttctatctcttgttcctttacatataccccaatatactgaagccagttggatgagctacctccgatgaccaacaaaattggttctggacatcctaggtcttcgtctttagataaattgaccattgttttcaaatctagtgcagatggcttaggagaagcattgggatgataatgccactcccctaaataatattgctgcttttgccacgctctttttagcttcgtaataatgccccgcgtactccgtacgaatgaacacaaagtttgcttggattctgctggagctcctgttatagtggttatttctgcccatttcaaatcatcagagtatctgccgatgaggattccgcctgtctcataaggatatgaattcatacataaactatgaatatactctagctcctgatccggcaacttaacaccatagcttccattaaagctctcgtaatatttaaaggtctcaattttctcgatattcatattgtttctcaatcaatcgcaggccattaaaaagtccatcttcagtctgtgtttcatagattaatgagatccctttttctgttgaattttgtacaaaagcttctaatgccttgactgtggtacaagcggcaaaccacatatcatctgccctggcaggaaataatggatgccagcagccaatgccatcccgaggaagcgcatctagattaaaatcattggaatctttttgaaaatatggttcgactaaattaagaaaattttcaaagtgaggcagttttgtcctttgaatattaatatacagtcgttttgcaccaagtccaacagaacttgagcagaatacaatttttcgcttccactctgttgcagataataacgccaatacttgatcctcgccagtggaatcaatgataatatcaaaactgctcaagtctggtactaatgccccagtttcatctatatctaaatacctttctgcataagtagtgtgaatgttagggtcaatattcgttaaccttttagctacaagtttacttttggactgataaagatctgtcatacataaagtatgacggcaaagatttcccatttctaaagcatttccatcgatacaggtgagttgtgttgccccagcacgagtcaacagttctgcaatagaagcgcccaagctaccgagcccaatcataactatacgctgattcgcaagcctatttgcaagctttccacgccccttaatcgtgcgtgcgctccagttttcgctgcgaatccatgatagttccatactatccaggaatatctttgctttgtcattcatccaccagcccgcttcactcgggcggtagccttttcttgctccgtaagtctgaggaatgctaagtcgcttgccagaatgaaaaactctatttgtatattttccgcaggatagagcaggaagctctatagcctgccaagtcatctcgtgggaatcttcaccgatatgtgctgggattggaaaaccaaccaaaagcagatgccgcctcccatctctggctttgggggcaaatgatttcaaaatggccagcaaatcaatgccctgattagtgcatatctgcttcaactgacataggttagtgggaacttgccagttattaataactggtacttcttttaatctgatccaaagtgcattttcatagtttttttcccttattgccgttccccaaaccggttgatagattaccttctgagaatcaatggagcgaaagctccgaatcattgctatggattgctctgatgaaagttgcctacgaacgattcttgcaattccacaacgctcatccgtactttcccagatcatcatggaaacacaatcctcttgaaaagcaaagactgtctgtatatgagagactggaaaatctggtaactcaaaggcatccccattttttattaatctctcttctgcagccgcacggagccacaaaacagctctttgcatattccaaaagagccgttcatcaactgtgaacggctctttttcaggaacgcggatgccaagagtctgatcaataagatcaacacagagttttcctttacgccacaaatggttttcttcctcaaaagcattgatcgattgatgtggaaatgtatttgttatactatttttgcagctcggatatatagcaatagttccaaagggataaacagtttccgcagtaacaaaccattctgttactctgggaatatctttgccatcatggtccaaacaaaccctaatgtgaagataaaaacgttttgtaactacatcccaagtccaatctttcagcaaaattatttctggtatttcttcaatccggcgccgcccgcgtcgcaaattctcagttggattctgactcatccaaacctcccaacaggaacgcccttactttcctgtactctcggagtaaatcctccgttttttctataataggatggaaattcatcgcaatctttgaagaaagatttccaaaggttaacactctcttctatatcagcgctatcataagctgctctagcaagtcttgcaccgccgcaaaccgccttatagaaagtgtcataatcctcatctgagagcatctcaaatacgtcatgctcaggaacccccggtctgggaggaatggctttttaggataacattccgcaatgcactccaaggttccgacgatgccctctgcaacacttgtgattccatctggacaacactctcccacaaaatgttccaacggatagcttttcggatgcttgaggctaggtagttccaatcgtcgccaccatttgatcgctttaactacatttacataattacctttgcaaatttgattttttctcttggtccaacggatctgctctaaaggatgcgttcgataccattgattttcgacattatctggaatcagtaaaggctccgccctccattgttggccagtagaatcactttcgaaaaatctttccagtgaatctaagcggtaattttccaaaagtgactgctgatagcccgagagatcatcgactgtgaatgcggatgaaaggccagcacattcaatggcccttttcacctcttcgctgggagctgcggtaattactagatccatatctacttcgggcaaagaaataccgatcgaacgcttttgctgttcgtagttctgatagtacttctttacaaagggtgtaattatggcaaatgcttcttgggcagaaacggtatcatgatcaatattagtaactacaattacatctacatccaccttttttcctggtgctggtttaatacaagttgacctagcatagctaccctgtaaaaaactttcaacgagtaaatcttttgtaaggtcatcagatttgagttgttctcgaagctcggtgtgtgcggagatcaacgcttttttcaaactgtcaggtagccgaatattagtcaagaaatcctgaaaataagtttgtattgcgctcattcaagtcctcctttcccgtcaaactgaatggacggtatgtaagagcagttgcctcgttgttcaaaatcatattcgtacagaatacactttccaaatggacgggatacttgcccaagatgaaacataaacgcattaggcgcggcagcaaaaatatggagatatgctcgcctttcaacggtgcttcgtcctgccaatgcggcataaacttccattgccagttttgaggagtgggtgccattttgaatagaaaagccagtgctacctgtgtcctctggtgagaaattaataatccgtccaacgtgaaccccctgttctttcaggtatcgctccacatcagagcaaatattgtgcctcacgttgaggataagcgcggtgtcaaatgtatcttcatctcttgctatatgttctaccttccaattctgatattgggttcgatcgcatttgtcaaattcccatatttctggtcccaaaattgttttttgaacaggacaaatatccacaccggatttagtatcaaaaacacgacctgcagcaaaagcgatggaaccatgggcttccagcataatttggtaagcttgctgcacctctgtattttctctcaaaaaatcttgaacaggcttaccgatatcaaccgtccagtcaaaatccggtttcaaaaatctaccttcaaatttgtcttgtaaatctaacagaattgacgtctcttgggtaagtctttcagaacctcttgaaaaacacaaaattccaattgcttttcgtaccttggtgtacttcttgataattaattcgattcgcttgttcaactccaggctgaaaattgttcgatcggtatagccatcttttgttgattgaagaagttcctcctcaaccattgcgtccacaagtaaagatacttggggatgctccaaggaatgtccactatcatatgcatatttccaaagagcctctcgaacaaggctcttcaaactatctggatcgaatggcaacactttaaaatccacattaatatcttttagtaattgagtttcaaatttttctaactgttttttacctgttgcatccaacttacccgtttgaaacttggtaatagcgttcataaaatccacagctgataccgcacaatttccgattaaaaccaagcaataccgctggcagggataatcagtgatgatatcttttaaccacttagaaatatcgccctttgaaaaagagttgaccgtcgatttaacttggatcgcatctgtaattgtatctgcgctctttaaagcaatatctaccttgtcaccttctgttggaaattcaatgtaaatcctatcccaatcatttcgccttaatgcttctagaacagcaacaatcccttgatatagataacctctgccgccttcttttccgcccataatacgcctttctatttattgaaagagtacaaccaactgattacaatatattgtacgaagaggtggtaataaagtcaacatatcaaggaattatttaccaattattaatagtttaaatagaatgtgctatacaacacatcattcaattatcaactgcatgacttttacttaatgtaaaaaattacattagcccgggcggttttgggtgtgctgtcccgatgcctggccggcgtaaacagctgcaaaccgccacttgggattactctgaatgaaagctgtataatacgcaatctgtttttccaggcttgaattttgtttctcctgattcgtgctggtacggcaataggctgcaacccgcagctgctggtctcaaataggatggtccttctgcgtatacgggatcttgatcacatgttgaaacataagaagccctccatgatacatactgtcgaccagtttgtcatgaagggcgggaaaatgaaaaagctgcatttcggttcaaagaaccaaaatgcagcttttaacatagtctgaatgtcattaaaggatctgtggaaatccagtaatatcaatggtttgtaagcagtcggcaaaaggcttcatcttaaattgtacgctcccacactttcacttgcgtgattacatcacgcagacgatcaccaccaaccatatactccagaatttcgtcggcggtatcacaccatttctcagtacgagtgtttacttccacagagccagcctgacaaatcaccattttaggcgctgcatctgccgcaggagaaatacagccaaagcaacagtacagcacgccattccactcgaactggacttcgccgccgcgccgcatacactgtttgaaatcactgattgttttaaacctattatcttcaaggctgtttgtgccgacccatgttgccatgttcgtgttcctcccgtataaaaagctcttggtagtctgttctttgccgaagtgaaagcctgactgatcccatatgatgctatgttggtgtggaacttcatgatacttggggaaaccatggtttgtatggtgaatttccaaatatgcttttccgtcaggaccaatcagcgtttcaataagctctccttttgccgtataggtatattttgtttcgcccggctcaccccagaatcgctcatcctctggttttgacggtttgatttctccgccgtaggcgcttcctccgccttttccaattaggtacggctctattgtatcacgattattactggatgtgccgccaattttaaaggcatccaaatcttcacgatggaaacttcgttcatagttcatataccgccaagaactgcgttcgtaatccacatggataatgttgccctgcatttcgggaaacggtgtattataacagataattttttccggatcaatgcgccgcagcatctcgttgtatcctgccatgaaccattctttctggtcgcagcggttgtcatgctctgaggccatataagtggagacagcaacaacgcttcctttttcaatcccttcaaagcagaaatcaaacgtggattcatctccccagttgacagttggaatgacccggagccctttggatgcccagtaagcgccgcaccagcgattacgaaatacattgtaaagttgcataacaggcgccatctccaggtacatactgaaatccggcgacagcaccgcgcggtagcgggagagtttttcaatgtcattgtccgggttcttccagaccctctcaaagcgatagtcatataggaagaagtgtaccatgcggtctaggtgattctggtcctccaaatgggttttgtcaaaaccgatcaacaaaagatcatcgaagtctccgggactttcttggaacttaggaatgatggggatttttaactttcctttgccgggaaactggttgcgaagcagtttctgactggttcggtagttgtaattttcttcggtcatagatagccctcctgtatgtagtaaggaacaagtccttctgcatacaggttcccaaacaaaaaaagttgcacattcctgtgcaacaacatgagaaaatttacaaattggcagtaaaaaatcggagtaccccaaaggatactccgatggtccgagtggcgggatttgaacccacggcctcttggtcccgaaccaagcgcgctaccaactgcgctacacccggatagctgcctctcttccagggcaccaaggccccgcaaagcaacgtagtttattatacggaattttttggccgttgtcaagtgtggaagttgtttcgatccctatctctcaggactgcggccccaaggccgggggcacggtatgcgtgcccccggtttgattgcctcgttggttcaatgcttttttcagtctctcttcctgcccttccggcccagaatcacgatggctgctgcgccagccagagaggccgccagcagtgccagatacagcgccagctgggcagtgtctcccgtgggaacagagtcatccggttcatcagggtgccccggttcgtccggcgtatccggcatatcaggatccgggctttcgtccgggtcaggggtcggatgcggatctggatccggcatgggatcgggacccgggtctggatccggcttggggtctggatctggatccgggtccggcggcggagtcgtgtcgtcataattgatgattagcacttccgccgtgtctccgaacgggaccatcccggggttgtgcccctcgacgcgggtcccatagccgtccacacgcgcctctgccactgtgtagccgacgccggagggcaggcccttggctgtcttgctctccccgtctttcagggtaaatgctgccacgccgtcctggaacgtcatatccccgcagatgccgttgatggacttgtcgtcaagcgtgacggtgaaggagaagtccctctgccggtcaccgctgtacacttgctttttgacggtcaggttcccctttccgttgatgacgttccatccgtccacccgggtgccgtagccatccaccggctcctcctgcacagtgtaggtgtacgcccggccactgtcgtcgtaggcgggccagctgccgaaatcataggtccagctgccgtcggcgttcggggtgacttcccgctcggcaactttggtgccgttctgcaggaggctcagcgtgatggagttcggacggtcgtccgctccatcacccacccaggtcttccgcccctggatggcaatttccgtctccttgccgcccagtgtgttggtcagagccagcgtaccgctccctgtcacagtgtacgactccaggtgttcttcctccacccagtaggtatagggattaccgctgccgtccgtatccggcagatgctcaaaggtgtatgtccagacatcggcgtttccgtcctgggcatttttcgcggacagcgtcacttcgcctgctacttcgccctgggctgccggatccgttctgcggtagagggtcagcttcagcgtctccgggcgaaggccctgcgcgtcactgtcatcccgccaggttttggagaccgggatgtccgtatagcccctgttggtgatggcagtggtgaacgccaccgtagtttccgtcggttctccatgatcgtagatcacttccatgtcctcgtccggggttccctgttcaatggcgtaataatagtatttctggttctggctgtttactttgtccagctctccgaaaatatggcgccagttattggccgcagacagctctgcggtcatgccggcgacctgctccactccatccacgccggtcttccccatcaggttcttgtccgtggtccgccagagttccattgtgatcggatgtttcttggtatccgcggtgtgccatttcttttccactgtcagggatgtcacagctttattggtgaattggaattcagggtaggtcccatccacatcggtcttgttttcctttttcgtatctcccacctggacgtagctgccgctgaccgcttcggtcacgcggtattctgtctcggagtcggagtccggcagatagctgcccggcattcgggctgggaggttctcccagacggctttccactctgcgtactcgtaatagggtttgtccagatcaggatccgtagttccatccagcgtgacggatacagccgtcagggtcttccacgtatacgccgggccctctgccggattctccagcggaaccgcatattgcaggtgcagggtgacctgggcgccctcctcgccggcaggcatccacgtcttgccggcaaagaccttggtggtctgcatgtcgttggccgctgtggtgaggaagccgtcgtcagactgcccgccataggtgtaggccgccgtgtacgcctcgttgtaggaatctctgagcaggacatagctgctcaaatcgactgctccgttcgtcatttgatatcctggctcaagctccacggcgcgataggtgtactccccttccgcattctgtttcggcaggccggaaatcgtcatccctaccggcgattcaaccgtgccctctgtatccgttccggtgagggtcactaccagatcctgcttttgaccgttttcgccggtcacctggacggcttcccatgctgccgcttcccagccaacagatagatccgtggtccgctgaatcaggaaactggtctcccaggtcttgccggcttcgtctgtatccggacgggtgccatagacgttgttccggtcgttcgtccaaatcttctgcacctgcagcgaggtcgtcgccagcttgttggtgatggtggtcgaatttccggattccgtgtaggtgtcttcaattcccgtgaaaaggccgccgctgtctgcaacagtgtatgcgaactcttcaccgcaggtatcgacagtaatcgtcgcggctccgccttgataagcgatttccgtctccaccacgcgataggacagctccgaaatcccgctgtctttttttactacacgcggcaggttctcacaagctccactccaggaatcatagatatgccggttttccaatgtgatcgaaaaaccattgagtattccggcatccttcagtttctcgtacgcgtcttctcccaggttctcctgcgtgaaatagtccgctgccctctgccaacctccgctctttccctccttgacatacagctcaaaggtgacggacatctcgccaaggtccatgtaatcggcagtgatgggctcgccatcgctgcccacccaccgcttggtgaagggggctctggtctccagagagtttttcagctccttcatgtggatggtgtcgccgtctgcggagtcctcacccgctgtcccattgccggtgaagtaatattggtaccgctcatacaacgcttccttcagatcggagttcagctcttccttcacggtgtacacccaccgggcgccgttgggggcccacttttccagctccgtctggggctgcgcggcgggaggcgtctcttcggagggatcctgggaatcggggtctccgatctggtccggatcttccgcaggttctgtcggtgtgaccgggacgctgccggcgccgccatgttccccatccgccggatcgctgtgcaggctggcggcactgagggtctcctcctgcggggcggactggccgtccccgtctcccgcctgggagtccgggttctggtcttcttccccatctgccggaggttccggactctgtgtatccccttcgtccgtgggaggatcggcgggctggtttccctcctccgggggcatttctgtgggcggcgttgtctcctctccctggccggggcccggttcggcgggctcttccgcggagatgccgggctcttctgcatccggatcgtccgcaccccagatctgataagtccactttccggtttctgcatcctgggtccacttgacggtgtagtcctcgccctctgtcagcttctcctcgatgtgcgggtcgccctgccctcctgggcagcggcgcggcgggtcacagtgagccggataacggggaccaatgtaccatctttcccctcttcatagggggcatccggacgcagaccgaaggcgtcgtaaaagtcctcccaggctttttggcccgtgagggtgacgaactctgtctgcacagccttccggctgttcaggaacgtggcgtcggcctcttcccgctcttcatggggcagcagaccgccgacagtatatccgtcccctgtgacgtcttgggcctccaggtcgcccgggccgcaccaggtatcgtagccgcccaggaagctcttgtcctcctccacatgatagaggtacagcgagccgttgggcgcatactgctccaggcctgtaaaggaaagaaccgtttcaacagttgtgctgtctcctcgctgctggtaagccgcctcgacctcctccgaggaccaagtggccgtccgcaccagctcctgcgcggagggctggccgttgttctggatgtagacccggtacagatggaagcgcacggcggggtaggcgatgggcaagtcatctccgcccaaaggcagttccaggatttttttcaccgacagactgccagtcgggctgtggaacacgttctccacctggaaggtgttggagatctcctgtatatcaaacagatccagcgattcctggggtccctcgccggtaccgtccaggggcagcccgttggcgccggtgatgccttcctcccggagaacatattcgtacagcttgccttcctccgtgtatttgggcagccttggctggtcttcagattccggccggacggttccggctccgtcatcgatgatatttttcccctcataaaggagccggaacgtatagttcttcaggccggaccagtcctgaacagtcagggtcgcgatgggggctccgccaaagtcaaacgcctccccgctgccctgcacccgccggtacagtgcgaaggtgacgttgggcaggtccaccgccggatagccagcgggcaggttggtccacagcttccgtccctcaatggcgaccggcttattcaggcggttgacgaaggtaccatttgcgttcagggcatatttggcgtaagaactgctggcatcctgagacactggtgggttgacgccgtccaggttcgtggtctgcgcttcgtaagccgcctccatccccgggtcagcttcgtcacgcgtgcccagacaagtttcacccgtccagtactccgcaatggcgtagtcaaagtcggaggcgtttacactggtgcgctccaccgcggagtaagtgatcttgtaaccccagtcgtcatacttgggcaagttctccagctcggcccgccagaaatactgccggtccgcagatccgttatccccggaggcggtgccgggctcctcacccgcgggatcgcctgctccctcggacggcacctctgtctccggcgggagcaggccctcgtttgtccagcggtagctgggatagatcagttcggtttcgatcccgtcctcagcagcagaggtatgcacagtccggtaaatgtccagatagatgtccggacgactgccggagccatacatatagatgtcgtaccactgcttgtaccagacagcatccgttacgccggtgcgtttgttggtgagggtgatcttctgctcgtcattcttgttttcaccgtcatttaccgtataggatttttcctttacagagcttgtgtatgtagtccacagggcatagacctccggagaaatggtccgcagctgatccagcgtgatctcattgccgccgtccagccagacctcctctacggtatagcgcaccactgtgccgttggtgtcgtacttgggaaggttccagaagtcaagggagttggacttcgtatctgccgtgagaatcggctgaatagaggaaacccgtctttctcttctgtcttgaatctgtacatccccgccgcccaggttcacatagccaaatccatctttctgatagattttaaattgtccttccgtatcatcgctggcggcgatcttcagcttcacggccagagtgaggccgggggtgttctccagggctgcctggagttcccccacgccgtctccgccgccgtcccgccagtccttggtgacggtcaggtccacattgcccagccggcggttggtgacggtgcagaccgtctcacccgcgatcttctcgcggtcgtatgtagcttcataggcatggtttctgccggggacagtgtcgcgggtgattccgggagcgttgatctctccctcggtcggggcgccttcggttccaagaaccgcaatcgctccgattttggtctcccggatgtagacctggtccggcgtaagttctccaatgccggcccatgcgtaccagatgggatctccgtcctcctgggattcgcccagcgtgacggagacaattacctcgtctccatttctgctatacaccgtcacttccactggctcccggtgggcggcgtcgctgtcgtccacccagttcttctggaccaggatccgatggcttcctcccgggccgttggtgacgatggtcgtatagtctccggtgctgctgtcgatggaggtttcataggtggggttcccgttctcctccaggatcaggtattcataccggcgcccctcttcgtcatactccgggaggttctggagcagggctttccaggcctcagaaaactgaatggaaatttcaccgtcgatcgcatctatgaatgcgttttccttcgtgaaatcaacattgacggtcccacctgcatccattgtaaaggtaagaaccttgcatgtttctgtcagagactgttcgccgatggtacggtacagggcgaaggtcaccggcccctcctgggcgccgcttttccacttcttttccaccgtataatctatctggttgctgacggcattggtgatctcggtggtgttgccgttctccacatcggtcacacggtactttgcatctccccggctgccgccgccggacagggtaaacgagttgttgtccagaagatttgttttattctcgccctggtaaaccaccgactccacccagcggtactccagctcccggccctggttgtcgtatttgggcgcgctggcgctgacggacaggccgcccaggttctccgccgtaaattttcccgtttcctccgtccccagcgtctcggtgatctccgtgtcttcccaggggtcctcactgcccaccggccgggcctggagcgtcagctccacccggacatcctccagcgccgactggaaagccgccgctttccagatcttggtcgcattaaccgtcaccgtgccggagagcttgttggaaagggttcccccgttgtagaggtatgtattgttcgtctcccgtgcaaagtctgcatcctcgctggtcagttttttcagcgtaccggaatcctcgtccagcgcccagatgatgtccgtcacgccgccgtcttcccccaccgcgccgaatacctgggtgtagtcccccgcatgctcaccagtgagatactctcggaccacatagatatactcgtagccctccgagtcgtacttgggcagctctgcaaactgaatgtcctgtttctcctgcccgttgagcgggaccgtcagaatgctgcccccatcatcccggacgggcgcggccgttgtgtagctctgcccggctcggtaacgccacagctggagttcacctgccgggcggtgatccggatccgccgcgtcctcccagactttggatgcctgataatccttcacgcccgtgagcgtcaggtacaggctgccgccgtcatagagcttccccacctctgtgcccacgttgggcgtgctggagttgtcgtaggagatctggaagtagtcgccctcgggcagggcacccgccgcgatgccgtcggcggcgtccagccggccgtcgccttttccgtctccctccctggtctcctctaccgagtagttgatccggctgccgtccaggttgtacttccacagaccgctgacggtgacggtgccgctggtggggttgtccgggtctccatcagggtcctcttctatcttcatctgatccttcatctctgccagcagccggcggagggagcttgccgtatagttggtgtccaccacgaagtcaaagctgttgtaaatggcttctgcgatgccttccgcgccgcccagattaccccagcggagctgaacgcggaagttgaattcgtcctccagcacatagtaccagccgtagttgtccccggcggagggatattccgacacattgccgttgttgacctctaccgggctgtagccgtcaaccccttcggacggtcccatgatccactctacacgggattctgttgaggtctccccgccgtagccatcggatgttgtggtttcgatcgcttccggcaacacgccggtcgggacggagaccgtataggtgttgttcccgttgtcggccaccgtcattttcggcatagcggacaggcccaccccggagagcgtcgagtcctccccgcctttcagctcaatccattccccgttgtcgatccggaaccacagcgacggctgatacgtattcgccccgggacgcactccgtcctcattgttgttatccacccagtagagcgtgttctcttcaaatgccccggcggcataccagcttgtcaccgtcaccaccgtatctgcgtaaatcacaggcaccagggtcagacacagtaccagtgccagcagcccgctgaccagccgccggcctcccttcttcggaaactttccctttgggagccgcccccgctcccggactctcttgcctcgatacagcataacccctcacctcattgaaaaattgttcacacacatatccagtgcgtccctatcgtccacgcccctgctgcgtcggctgggcaggactcagctgccctgctcccagcccacagtcagctgctcctcttccagcatccgctcgtgggcctgctcggccagtatctgtacactgtcccgaatgcgttcctgcgtgacctgatacagcctgcgcagacagcgggggttgctcttgtccccatccacccgggcatccctgcacagagtccggatctctccgctcacctgggtcctccgcatggggcggccgcttcgggtgacgaataccggccccgcagtgatccccacccgccggagatagactgccaactccttctgcagacaggcaggaatcaggacgtactgcgctctgccgtcacaggcggtcagaacacgtccctcctccaccgcccggaccatcacccggttcagctcacttacgcggatccctgtcagggcaaagaccttcaccatcagatacgtacgctcccggcccagattccgggctgtggccagcaggcgcagatactcagtccggctcaactccggctggatctcctcttcggtgtccagctggccgatcagctgcagatcccgccgccccagataggccagcagcccattggcggcggacacatgggtgttggctgtaccgggcgagtagccttcccgcagcaaggcggcgcgccagagctccagtgtgtctgcagccacccgcttgtcctccggaagaaagtggtaaaacgcctccagcttggggcggtagacctggatcgtctcccgccggcggccccgggccgccaagctgtccagataccggcagacttcttcccaggtaactgtcagctccgccggcgccgcggtcctgtcctgtagtgccgtttccatcgcctcacgcattgggcattctctcctctccaaagccgctttcactgtctgaatgctttccaaatatctcctccgtatccatctctttccgatttacaacagaacaatgattctgttgtaaacctgtcatcagctggaaatacggtgccagagcacgaagagtcggttttggccgaaacggcacctttcccttttgggccgcaaaattggaatcctcaaaaaatccaaaccgcaaaaaaaggacgttgcttttgtagtttttttgttttatactaactatattccaatgtatgtagtggagagagctttgtcgatttacaacagaatcattgttttgttgttaaacgatcagccgcattttttccagaatctgttcatgggccctggcgctcactgccacataaatccgggttgtctcaatggaggaatggcccagaaggtccgccagatgcgccagatccttctcctgttcataaaagcacttggcgaacaggtgccgcagattgtgcgggaataccttttccggcatcacgccggcctcccggcagagggttttcatttcatgccagatgttgctgcggtccaggggccgcccggtgcgggtgcggaacaggggcccctcctggatatcctgcgccctggcataccgccgcaggcgttccgccagttcctgcggcagcaggacggtccggcactttcccttcagccggatctccgtccggccagcacgcagggcctccgccgtgatgaagcgcagttcgctcacccggataccggtggcgcagatcgtcagcatcacgtggtacagccgctggttcttgcgccccttggcaatagagagcagccggcggtactccgactccgtcaggtcccgctgctcctcccgaaacgcccgccgctgaaccttcagcaacttcacctcgcagtgctccgctccacagaaccgcagatacgcgttcacagcagagagcttgttgttgaccgtcagagccctgtactgctgctgcaggcgctcccggtatgccagaacacccgccttggtcaccggggcgccgcacagagccagtcgcagctgttccgcctcctgcacgtatttttccactgtggcacgggctttctcgttttccaccagaaattcccggaacgcggagatagactgtcctgtgagcgtgatttcttccatcttgactcctcccaaatccgcccgcacagacgcgggtattttttgtaagcatacccaaaatggcgtcggatatgttccgcctatggagatgctttccaaaaaagttccgaattgcgcaaaaaggcagcccgcggagaatccctccgcgggctgccttacagtatgctgttgttttttatcggcctccccagacccggtagagctcgcttccccgttcccgcaggcgctcgttcagccaggagcgcagggatgccatgccctcctctgtccaggggaaggtctccgtctcaatgtgctgggccttttcaaagcagatgttctcatagacccaggcctggacggtgccatcgttcacctttcccgtccgctggaagcggtagcggaaggtgccgagggagccgggaaaaatctccgacttcttcagaaagttcagggtcaaaaatgcgaatggatcttccatcgggcagtttctctcctccatcaggccgcctccgtctcccggcggcagaccttgatccccgcgatggtcagcgcgaacacgaaccagaaaatgcacatcacccggggatagttccacaggtaatccgccagaccgcacaccatggcgccgcacagagccgccgctccggcacaggtgatggtgcgggcggcagagggggcgcagtgccggaccgtgcgggccgcctttttgatgttccacagcatggagcccacaaagcccagaaaccccagcagtcccgcctcgatccatacctgcaggtagaagttgtgggcgtgaacgaagggcgcttctgcgtggtagaggttgaagtcgctgatgtagtcctgcacggcggcggtgcccagacccgcgccggagacgggagacgtccggatgacctccagtgccgcctgatacaaggggatgcggctggcagtggaggtatccgccggattgaagatcgtcaggacccggtgccagatggtgtccggcaggaaagggaccatcaccacgcacagcaccgcgaaggcggggatcagcttgggcttccacaaaaacaccagcaccaccatggcacaggccatgccaacccagctggcccgggagtaggtcatgcccagagccagcacacccacggcaaacacgccgcaggccgtcacgcgggagatgccccgcttggagcagaggatcagcgccagtaccaggggcagcaggaggatcagcacctctgcaaaggtgttggggttgtcgaaataggactccacccggccgggcataccggcgttgacctccaggtccacataggactcgttgacctccacgccctggatccgttggtacacaccgtacagcgaggacaccagcacacagaccccaccgccggcggccagccgcttcaaatcctctgtgccccggacagcgctgaccgtcaccagcacgcacagcgctgcggagatatggtagagcaggaagcggaaggaggcggagggctcataggagaacagcaccgccaggaacatggctccgaacagcaccaccggatagaacccgatgtgcttcacgtccagccggaagtcccgccgggacatggccccggcatagaacagcaccagcagggcggcaaagcccagcatactatatgcgttgttccaatgcgagaagggaatcacccacaatagcatgatgagccaggattgggcgacggcggtctcatgtcccatctcaaaggccagacgggagaaaacgctgtcatcaaacgtagcccgcagggcaaggtacagcttgtggagcagccaggcaggcaggttgatgaggcccgtcagcagccggcagaggatgctctcctcccaggcccgggccgcaacgccctcccggcacaagacccggagaacacggctctcgtcgatctggcggttgcaccaggcgcccatgcgcaccaggcagcggtggacggcgctgtcatagtagacggtgcacagcaccgcccataggtgatacagatagctttcgcggagaatgctcatgcagggaaacctcgtttcttcagatgcggtttttgatccggtacagctgggagagcagccagaagcggcccccccgcaccagctttgctgccaactgcttgttgcggctcatgccggcgggcgacagcgtccggatggcgtgggccatatccggccgcgcacacagggcctggatggtctcctgccgctgccggagggtcttgggattgcccggggcgtactcgttgccgatggcgatcaacagcccggcccagttggagttctcccgccactgggggcggccgggcgtcaggccgtaccgggcggccaagtcctccttccgctccatgaagcggccgaagacctgctggaagtccttcatatacttgtgggtggcggaggccggattctggagatagcggtacaggggcgtctccgtcaccgccaggcgccgggcgttgcagaaatactccatcaggaacagctcgtcttccagataggcgccctcatagcggagatggagtctgtcaaaaatctctgcggagaacagatagcgccagatgaatccattgaacaccggctgggccagccggtcccccagcaggggattgacgattttctcccggatagcgtcggcgtcgtagatcccggcgggcagcaccggctccggcgtctcgctgccatcaggccacaggttcaggtgcgcacaggcggcggtatccgccccggcccgctcccgcaggttccacagcgtctccaggcactggggctcgtactgatcgtcggagtccagaaaggcgatataggtcccccggacatggtcaaggcccacattccgggtctcgctgacgccgctgttgcgctccttgtggaacacccggatgcggtcatcctcccgggccagctcatcgcagagagccggggagccgtcggtgcagccgtcatccaccagcagcagctcccagtcggaaaaggtctgccgccgtacgctctccacgcagtctctgagaaatttctccgcctgatagacaggcacaatgacggaaatgctgggcatagacagcctccttgcgccctccggcgcctctcttcagtctgcggcgcggaaactccggcgccctccccccagaatctggggctcttacacggagctattgtacccgatttccccgggaaggtcaacgtcttttcccggaaaagccgggcatactaggagcgaggtgatccaatatgaacgatatcgagctgctccaatacgtccatgagacggcggagatgggcattgaggggctgaacagcctggacgggcaggtccgggatgacagcctgcggcgggttctgagccagcagggcgccgagtaccgccagatcgcggatcaggcggagcgcctgctccggtctctgggagaggagcccagggacccaggccttctggccaaggtgtccgcagaggtcatgtccactttcaaaacgctggcagacccctctgcatccaacatcgcggagatggtcattcagggaaacaccatgggggccaccaaaagtacccggcatctgggggactacgccggtggaaaccgcgagatccgaaatctcgcggagcggctgctgcacaccgaggaagccaacgccgcccagatgaagcagttcctgtaacacacccggcgcaaagcagaggaggagcctcctacgggaggctcctcctctgttcaaaggaccggcagcagatcttccccattcagaaaacgctcctccgcctcctggatagggatctgccgctgattcagtctgcgcaccagctgctctacctctgcctgttcccttcccggcagcaggaccaccagatgtcgctccggttcccaggattcgccgctgaatccgaatcgccgggggtgccgggtctccagaacctgatagcgcacctgcggccgcaccgccttgcgccggcgccagatcgacaaggccagcacccggaccagatccttcggcgtgggcttttcccgcagcacgcgttgaaagagcttctgcagctccgcccggtctccgcagtcccagatgtcctccgccgcccgggagagggcctttgccagggtgtccttttccttttcactgtatctctgcgcctccggatacagcgtctccatggagaaggtgcccggcatacgggggatggcagccttgaccaggcagcacaggtcgtaatagcagtcccggctcagtttcccactgattttttccactgtccgcaggatatcttcatccatccgaaaccgtctcctctcctcttcaattcatacatagcatatcaaaaatcgcaggtttttgaaatagattcgacacattcggactcttttagacaaattacggcaccccggacttgacaatccggaggaaatgtgctcttctacccgtatcagagacagggaggcgcaggcatggatattcgcagaatcgagtcgggcaagcgggactttctccccctcctgctgctgggagacgaacaggaggacatgatcgaccgctatctggaccgcggaacgctgttggcgctgtacgacggcggacttcgcgccgtgtgcgtggtgaccaaggaggcgccgggcgtgttcgagatcaaaaatctggccgtggagccggcctttcagcgccagggctacggccgggccatggttcggcatgtggccggcgcctgccggaccgccggagggacacgcctcctggtgggcaccggggacagtgccctcaccctccccttctaccgggcctgcgggttccgggaaagccaccgggtccccaatttcttccttcaattttacgaccaccccatatacgaaggggggcggcttttgtcggacatggtatatttgtccatggagctttgagcggaaaaggcggcgctgctgaaaatcagcggcgccgcctgtatcataccgtttgattcagttttgaaaaaggcttcacgcctctgcggcggccttcagagcctccgtgcggtcagttttctcccaggtcacgcccaggtcctcccggcccatgtggccgtaggccgccagcttgcggtagatgggcttgcgcaggtccaggtcccggatgatggccgtgggccgcaggtcaaacaccttgcggacggcagtctccagcctgtcgtctcccaccgtaccggtgccgaaagtgtccaccagcacactcaccggctgggccacgccgatggcgtaggccaactgcacctggcagcggcgggcaaggcccgcggccacgatgttcttggccacgtaccgggcggcgtaggccgcggagcggtccaccttagtgggatccttgccggaaaagcagccgccgccgtggggggcgctgccgccgtaggtatccacgatgatcttccggccggtgaggccggaatccgccgccgggccgcccttgacgaaacggccggtggggttcacgtaatactttgtgttctcgtccagcatgtccgcggggatcacggccttggccacctgctcgatcatgtccttccggatctgctccagggagacgtcggggtcgtgctgggtggagatgaccaccgtatccacccggacagggcggttgtgctcgtcatactccacggtgacctggctcttgccgtcgggccgcatatagggcacctggccgctcttgcggacctccgccatgcgcttgcacagcttctgtgccagggacaggggcaggggcatcagttccggcgtctcgtcgcaggcgtagccgaacatcatgccctggtcaccggcgccgttgctcagctcgctgtcggtgccctccttgttctccaaggatttgtccacgcccatggcgatgtcggcggactgctcgtcgatggaggtaaccacggcacaggtgtcgcagtcaaagccgtacttgccccggtcatagccaatgtcccggaccacctcccgggcgatgtgggcgatgtccacatagcagctggtggtgatctcgcccatcacgtggatcaatccggtgcaggccgtggtctcgcaggccacgcggccgttggggtcctgctccagaatggcgtccaggacggcgtcggagatctggtcgcagaccttgtcggggtggccctccgttacggactcggaggtgaagagatagtgtcttgccatagtacaggttcctttctgagcactgacctcatcaaggggcgaaaaaaatgtgcgtttcgacggcgaaacgcacaaacggattggttgcttgctcctcatctgtcgatcaccgccggatttggcaccttgtcataagcaggttgccgtgggttcatcgggccgttccctccgccactcttgataagggtaataaaattgtccctattatcttatcaggtttttcccgtttgtcaatacggtttttccggttttgcggagaaatccgtcgccccgtcggaaaactgcgcagatgttccgcctgttcaaaaattatacatgacttttttcctctgatcgggtataatggatatcgcttgtatatttgaaatgttctggagggcttcaccgtgagaaaactctgcgacagcgtggaccgcttttgcctgcagcatccccgcttcggcattccgaacctgatgaagtttctggtggggatcatggccgtggtatttgtgctggacctgttctccaatggctatgccagctatatgctgtacttcaacgcagagctcgttctgcagggagagctgtggcggctggtcacctggatgttcctgcccaccaacggctctctgttctggatcttcatcagcctgtccttctactacttcatcggcacctccattgaggagtactggggcaccgccaagttcaccctgttctatctggcctgcgccgtgctgatggtggtattcggcatgatcagcatactgtggtccccgcttcccgttgtcagcagcggcaatctcaaccagatcctgttcctggcctttgctaccctgtaccctgacgcgctgatccgcgtctatctgatcctgccagtcaaggccaagtggctggcggcgttgtatgtgctgctgaccctgtatgacctgctccgttccggtatgtgggcggcgctgttcacactgccccagctgctggccgtctggctggtgtatctggtgttcttctgggacaggatcggggaccttctgcgggagttcggctttgccgtccgccatcagaactcccaccagaccatccagttcaagtccgcagtgaagcagcagcggaagaaggcccagcagcagggctaccgccacaagtgcgaggtctgcggccgcacagatacggactttccggacctgcagttccgctattgctccaagtgcgcgggctaccactgcttctgtgaggaccacatcttcaaccacacacattttacgcagtgagcgtttccgcggtctccgcccatcggggcggggaccgcttttttgacacggcccctgagatttctcttccttccggcccacaaatgcggtatactgaaaaaaacgacaccagaggaaaagggagacgatacccatggaacgacaactgggaaagcccctgcatattcaggcggcggaggcctttgaatcgcccgcgtttcttcagaagctgggaatggcccgcgccgacgcggagcgtatcttcggcggcgccgactggcaccagctgctccgggatctagtgcccatccggggccggatctcctgcgccgacgccctggcggccttccgccccctgctggaccaggtggcgccggatcccgctgagggatggctgtcctacgcctaccaggtggcccgggcgctgctgtatccggcgtcggaccccggacatacctccgcccagtgggatggagcgctgtgctttctgcagctgctccaggtcctgtttgacgcggagcggacctgcctgccctttgacttctggctggactttgaattctgcacggaggaggaactctcccacagcggtgtggcggaggagtaccgccgcttctgctaccggttccgggaggaatacatctatgagatgctccgcctgagccgggaggtcacatccttccgcaccctggagcacatcgccggcgtccactatgtgtccatgcgggtggcccgggccttctgcgcctccggcggactcatcgacctggggctgatctccggagccgccctgggccacgacctgggcaaattcggctgcaagcccggggaacgggtgccctacctgcactattactacaccgaccagtggttcacccgccggggactaacggccctgggccacatcgcggccaaccactccgtctgggatttggagatcgagaacctgtcctcggagtccctgacgctggtgtacgcggacttccgggtgaagcagacctatggggaagaccgccgggagatcccctgcctctactccctgcaggaggcctttgacgtcatcctcagcaagctggacaatgtggacgatgccaagcgcctgcgctaccgctatgtctacgccaagctgcgggactttgaggactatctcatctcctttggggtggacaccaccctccgcaccgccggcggccccgcccgcccggccaaaaatgctgccctgctgaacacggacgaggtggtgaccgctctgcggcgtaccgccgtggaccacaatatccgcctgatgcaccggctgggccatgagcagctcttcggcaacactctggaggccgcccggggcgaaaagaaccccgcccggctccaggcatacgtctccatttttgaggagtatttcacctactggaacgcctctcagaagcagcagaccctggactttctgtatgagctgctgctgatcccggacggagacatccgccgccgggccgccgccctcatcggacgcatcctggccgccttccgcctgggctatcagaaggagcccccggccgacgccccgccggacccggaggaagacctgcccttccagctgtgggcggagtacctggaaaagctcatcgacccggaccggcggctgacgccccggcagatcagcatgatccgctatcaggccaagactgcggcggacgcgctgctgatgaactgctccgacgccgacgccccccgctttgccggggagctgttccgccactaccgccgcccggaactggtggacgccgatgcggcctttgccctgctggacacggtgctgagcctgccgctggaccgggtatccgccgaggatctgcacgtgctgaccggcttttccgtctggtggctggaacggggcggcctgccccagaaggccgccgccctgcggctgttccaccacctgctgacggccctggaccccaatggccgggacgccgcggccatcactgccgccgtggaggcagcggattgccagggaagcacgccgctgctgtttctccaggcccgcctgggagagcggctgggcctggatgtctccatccagcggtccctgttggaccggcaggacgttgtgagcaatgtgtttctggacaacctgaagactgcgacccactgggttctgaaggccgtgggcgtggagtacctgctgggtcaggtggaacagggagaccgcgccaacgtgctccacatcgccacccacttctccaacctgatgaaggtcagtgagaatatcgtggtccgccggctggcgggcgcttccctgctggccattgctccggccctgacgccggaccgccggaacgaggtggccgtggagctttccaaggtgctggagaccgggcagacggagatctcccagtacatcccccagtacctgggccagtttgccctgtggctgacgcccagggaactggacgagatcgtggatcagatgcagatcctcctctcctccgccaacaccgtggtggtggccgccgccctggccactgtgggcgccatgctggagcattatgccatatacgcccagcggttccacgagtcccgggaggtactggaacgccgctggcggcggctggcaggcctgctgttgaagggcctggcctcttatcgtcagagcgtgcggcaggaggcgctgcagatcctgggcgagcggctcttcgcctcacagaccctctcctacgagggaaggctgccctcttcaccctgatggccaagaagatcctcttcctgctgggagagcagccggaacaggagctgagcttcttctacaccgccgccgccctctcccacatctaccgcttcatcgtctcctatcagattgaaagcggagacttcccattctacatgccgggaagggccgccttctttcccggcaccttcgaccccttctccctgagccataagggcatcgtccaggagatccgggacctggggatggaggtgtatctggccatcgacgagttctcctggtccaagaaggcgcagccctccctggtgcggaggcagatcgtcagcatgtccgtggcggacgagttcgacgtgtacctcttcccccacgacatcccagtgaacctggccacgccggaggacctggaccggctgcgggaggtcttttccggccgggagctgtacctggcggtgggctcggacgtggtagccaacgcctcctcctacaaggcggcaccggtgccggggtccgtccactccatgaaccacatcgtcttccgccgctccagcgacgcggagggacgggagatcgacgcagatctgggctgcatctccggccgcatcatccagctgcagctgcccacccatctggaagacatcagctccacccgcatccgggagaacatcgacctgggacgggacatctccaccctcattgacccggtggtacaggacttcatctaccgcaacagcctctatctccgggagccccagtacaagcggatcctccgggcgggggatctggagttctcccacatctcccagccggaccggcacctgtgggaggagttgacggaggtaccgcttcaggggcgggagcagccgccggagatcgaccccagggacggcctctgcatcctgcgggacgcgggatcccgcccccgggtgctgggttttctgaccctgcggaccgtgaactccggcgggctgtatgaggccctgggggacacggagctggcggactatgtccgcaagcacacggcggggcgggttcagctgctcaccggactttacaccgcccgcggctccagcggcagctatgatgtgggccagctgctgatgacagaggccctctcccgctccctgggagcggactgcagctatgccgtgtggcacgccactgcgtcggaggagacgctggacctgctggagaggcaaggctttgtcccggcggagctgcccagcgcaaagcccctgctgctggtggatatgcgctctccctccgtactgctgcagaacatccccaccacgctgaaggagcctttctcctccgaccgtaccgtgctggcggcggtccgcgccgcccactgccggatgcagcgggctctcaccggcctgtatccgggttctctgatcctgtccctgaacgcggaggtcatttaccaccgtctggtgcggaagatcgtggacctgaacggcgtcccggcggagcccacagtgccccgggtactgggtcccaagatgtgcgtacccttcggcaagatcctgcggggcaatgccatccccaacaccgtcaccaagaccatccacaccgacaaggtctttgccagggacctcacctccttcgacatcgagaatttccccggctacgcgccgctggagagccagatccgcaccatccactccttccgccggccggtgatcctggtggacgacctgctccactccggcaaccggatccgggcgctggatcccctcttccggcaggagggtgtggtcatcgaccgggtgctggtgggcctgctgtccggccgcggacgggatctgatggccgccaagggccgcagtgtggacagcgtctatttcattccgaatatgcgttcttggtttgtggagtccaccatgtaccccttcatcggcggcgacactgtggggcatgaggagccctccgtccccggcctgaccccagcggtgaacctgatcctgccctacgccttcccccgcttctaccgggagtgcggacgggaggcggtgttccgtttctcctgtgcctgcctggagaacgcccgggacatcctgctggccctggagaccaccttccgggagcggtacgcccgcaacctcaccctctcccgcctcagtgaggcggtgatcctgcccctctccccggacaagggcagctgtatgcactatgaccccagtcttcctgcctccgtatttctgcagaacgacctggagatgctgttgcggatgcggaacgtcctccaatcctgaccgcgggcctggcgcgccatccaggcgaaaggagcccttatgtattactaccgccacggggaggtcatcttcgcctctctgctgccggacctccccctggagccggcgaagcgtccctccgcagggacgcccagcctcttcctcatcgaccgggacccgattcgcagccggtcctccttctgcgtctcagacccccggcagctcactgcggagacggaggatgtgacctggctagacccctcccggatgggcgttccggtcccctccctgcccaaacgcctccagcacaccatcgacgcccggctgctgcgggcggttaacatccgccacccccgctgggctgactttaccaaggcgtccgccatgcatctgccaagccgcctgcgggtgaatctgctggcggtaggagatgtgggcagcacccttttgacggcgctgaagctcctgggaggcgactgtattgagagcatcggtatctgcgacctgaatcagaagactgtggcccgctgggtcacggagatggagcaggtatcctggccctgggactacgacgctcttccggcagtggagccggtagcggccggggacttgttccgctgtgatgtgttcctcttcgccgccactcgcggcgttcctccggtgggaggcggtgtccgggacgtgcggatggcccagttcggcgccaaccggccgctggtggaggactacgcccggcaggcccggcaggcgggattccggggactctttattgtactgtccgacccggtggatcccctgtgcaaggcggcgtatctggcctccaaccagggtcccgacggccagtgggacgggcaggggcttcgggcggaacagatccagggcttcggactgggggtcatgaacgcccgtgcggcctattttgccaagcaggatccccggttccgcagcttcctgctggatggccgcagctatggccctcatggtcaggggctggtgatcgccaactccctctcccattatgatgacggcctctcccgggagctgacggagctggtggccaccgccaatctgcggatccgggagctgggcttcaagccctatgtggcccctgccatttcctccggcgccatgcagctgctgctgacgctccgccggagctggcattgcagctcggtggctctggggggatctggttcggcgtccgcaaccgtttaaccgccgccggtctggaaatcgagactgcctctttgcccacaccgctgttcgagcggctgcgggaaacccagacgcttctgcgggagatcatttagcgggcggctgccgctgcgtttcatcataccggccgctgcacgccgctttgccccgcgcaccgggcgggtgctcggccggaatgcagccggatgcaggaaggagatgatcggcatatctgaagaactgacggtgatccgccccggcggggcgctctccccccggtgcgccggagtgctggaggcggccctggtggggcggcaggcagaggtgctatcccgcctggagggtccgctgacgggacggcggctcctgtttgtcgtctccctggatgagggcggcgtgaaccgcgggttctatgacctgctggcccatctccgcacccatccaaactgcctggaccgctgcgtggggagcgtgctggtggacgcccccggcgatctgtacaccaaggcagcgggccgggacctggtgctggccgccaaccttgcgggctgcgcctttgtgggtcgccctctggtggaaggcactggcgatctgcggaacttcacggtccaggcccgaaacgctggctgttctttggaagcggcctaccatctggcgacggcggatctggtggagcgggtgctggccttctcccgcccccggctggagcggccgaagctgctggccctccacgcctccagccgggccacctccaacaccctggccctgtgggggctggtgcggacccggctggaggaacgctgtgacatcacggagatctgcctgcggaacggcacgctggaggactgtgccggctgcccctacaccacctgcctccacttcggagaacagggcgggtgcttctacggcggcgtcatggtccaggaggtctaccccgccatccgggaggcggacgcgctggtgctgctgtgccccaattacaacgacgctctgtccgccaacctgacggcagccatcaaccggctgacggccctgtaccgcaccacctcctttgcggacaaggcggtgttcgccatcgtggtgtccggctactccggcggtgacatcgtggcctgtcaggcggcgggagccatgaacatgaacaagggcttctggctgccggcgaacttctgcctgctggagaccgccaacgacaagggcgaggccctggccctgccggggattcaggaccgggcggatcggttcgcggagaatatgttatgtcagcttgcatactagaagaaggcacgcctttcggcgtgccttcttctcagccgtagccgctgtatgtacaacattcgatgtcgaactccgccgcaattcttccttccgcgtcataggcaatcatgaccggatagcaaaccgcttccggcgactgttccaatggcaggggctccataatccagaaaaatgtccggtcccgtccggtgacaaagtcctcctgctccacggtcaagcggcgaagctcactgcgtaccgcttttccctggtcgtactcctcctgctgaatgctgatcaccactgtctcgattgcggggtcattgatctgtccaaaatagcagcccagtaccttgtcatcatggctgatctgatgatagcccgcatatatgggttcctcgccggtgcagtccaccgtagctccgaacatcgtctcccagcccagcggactgagatgggtatctcccagcatcacagcgcgctcgttttccatcaggtagaaaagatgtgttttatagagcgacggctcccacttccgctcaacgacccaggccctgccgatcccctcatgttccgcctcccgccggacagcctgaatcgggagcagggcgataccaaaaatatgatccacaagcagcaaactcaccagtgccagcagcacccgccacagggcctgccgtttccgggagggcagctttttccgtctcataatccctcctgttccggcaggggcagttccagacggatctgctcgtcaaatgcctcaaagcgcagtacgacgtatgtatcctccggggagaggcgcacatagcaggagccatattctaccctccagtttccccgtccgcttcccttcggagggtctctccttcctcccggcgtttccagccaggtttgctccatcagccgtctggacacaatgccgccgggaattcgatcatacgcacacagctgaacttccgcctcccacacacctggggtatcatccgcctgccctatgctgatccggtaaacccgcaggatgtcgtttccaactggaatgcggatatccaaccgctccgttgctgccacagcggtatatgcagacggttcattcggataaatacgggcggagatgctatcaataaccatccccaatattcccagggccagcagagcctgagcgcacagcaccactgtcagcaccaccgccgcccggctcaccagcacccagccccagccggtgtattgcctgttcagctcccgtcccacctcatctggctctcccatggcggcgatggcccgctcttctgccagctcctcgtcataccccagctcccgcagggcctccatgtggtcctcgatgtggccgtccagctccgaccgaatggcctcccgctccttctccgtcacacggcgcagggacgaaagcacccggtccgtataatcccgcctgtccatatcatgccgggtccagccccggacaggcctggagcaccgcattcaccgcgccggagtaggtctgccaggcggcagcctcctcccgcagcaccgccgccccccggcgggtaaggcggtagtatttccgcatccggccggtgggggcctcctgctgatacgcctccaccgccccgtcccgctccaggccgtggagcaccgggtacagcgtcccctccttcatctcaaaggtgtggtcggatctgcgggccagctccacgatcatctggtaaccgtacatatcctcccccgccagcagggacagcaccagcagctgggcgtggtccatggtctgcttttttgccatcgggcacctcctgtccaggcaacatacctagaattactatgcctttagtatacatagtaattctaggtatgtcaattacaaaaaacgcgcgcctgcccggcgcgcgcttttttcctcaattcttcccgatccccagcagatcccggccatggctgttcaaatgcggcgccagctgctcgtaggacagccggaactcctgcggccccatggcgtaacaggcaatctcatagggggagaaggccactgtcatcccctcctcattgaaggagaccgcgtagctgctccagtttgcggcaatgtcctgatagtcctcccagtagccggcctccacggcggcttccggcgtcatgtcgatctggcggatgatctcgtcccggaccgcgtccagaaatatctgcccgtccgctgccagaatctcaggcgcgaagaactggcccgtcatcaggtcgaagttccaggccagcagtaccgtgttggggtgggccccgccggtatagctgtaatactccgcctggatgcacaccatctgctccgtctgatagacagaacagtccagctccagcgtgtagggtgtccaattcccaccggactccgtccgaaaggccagctcctcctctgcccaagccgtcacctcgtcaaagccatccgccccggcccagtcgcggaaccggctgttgaaggcctccgccctctccagggccgccgtctccgccggggaggccgcctccgtcagcacagtgccgtccggcagggtcacggtcatctccggaagctcataggagcgcacagccaaagtcgtgccgtccgccgccgcggcgctgtcctccagcgtcttcagaaccaccgtgtaggtcaagggctcggatgcagcctgagtgaaggtggccgcgcccgtcatcgtgccgctgtccggctgcttctgttccgggacggcaatctcctgcgatgcagccgtgggctcctccgtctccggaacgggggctgcgcaggctgtcagcatacacagcagcaaaagcagggcgatcatccgtttcataggggttgctcctttcctcagcagggcgcaggccctcctaagatcacgggaccttccctccactccgtgccgccggcggcggagaggcggggatacgccagggtatacaggtccgtggcgcggacctccagttcaaacaggcgccgggcctccgggcccaaccgccggacctgcgccggcctggtcaacaccggcacggctgccgcctcccgcatccgggagagcagtcggcaaccggtcccattggccgccagcacccgcagatagggcacccgctccggcatatcgccgggcgtcagtcccaggtaggcccacagcaccatccgccgcaggcgggccatggcgtaacgcttcgtcttggctgcggccagcagttcgggcagcgaggcggcagcgcgggaggcgtcgtacagtcgattccaaatgccctcccgcccctggtccagggcggcaaagtccgccgccgtcatggaccgcagccgggccagaatggcccggtgactgttctcccagaacaccggggcccggccggcggcctcttccagctcataagcgcgggccatggccggaggcagcagggacagggcctcctcccgtttcccctgccgcagcagcgcccggaggccggaggccgaggggtgggtgtccggcgccagggcgccgtcgtgggcgctgccctccctccggatggtcaccggccggaggggggcgttctgccccagcagggccttgcagtactcgatgcccaaaatgttgttgggagactccagcagggcggcgtcctcctccggcagcaggccggtcagcgcccgctgccgggcagcggcaaagctcaccgctccaggcagcacctctcggagccggtctcggaaggacggcgccagcagcgcggcggccacccgctccagggcggagacatcgccgcactcactgccgaacagcaggtgctccacaaccccggtggccgccagcgcctggacgcctccggcggcaaatccttccgccgaggacaccgcccagggcaggggcagctccagcaccaggtccgcgccgctctccacggcagccctggcccgggcgtgtttgcgcagcagggcgaagtccccccgctgcacgaagttcccgctcatcacgcagaccatggccgtgtccggtcccagcgccgcccggcctgcctccagaagccgcaggtgcccgctgtggagcggattgtattctacgattatacctgcggcccccatggatttctccccttccaaatgacaaaaaagttacagtccggtgtcagtctcgtcaattttttatcaataccgcccgcatggggctttttttcgatcataccatactttccggaaaacgtccagccggaccgattccgggctgctctgcggcgagcagacgccgctgcgccggaacttccccggcaaaaaagcgccggttcgttcaaaattccggttgtaaccggggaaatctctggtataatgagaagtgcgccgggacccgccccgccggggtacgggttccctttcagccaggcatctgcctgcaattcatacgatgtggggatgtccacgggcatttccaaaaaagaggagacggtaaacatgaacattctggttatcaacgctggcagctcttccttgaagtatcagctgctgaatcccgagaccggcgccctgctggccaagggcctgtgcgaacggatcggcatcgacggcaagttcacctacaagccccaggtggagggcaagcaggtgctggacgccgtcgatgtggccatgcccacccactccgaggccatccaggccgtgctgaacgctctggtggacaaggacaacggcgtcatcggctccatgcaggagatcgatgcggtgggccaccgggtggtccatggcggcgaggcctttgccggctctgtgctcatcaccgatgaggtcatgaaggccctggaggagtgcatccccctggcccccctccacaaccccgccaacatcaccggcatcaacgcctgcaccgccgtcatgggcaaggacgtgccccaggtggccgtgttcgacaccgccttccaccagacgatgcccgccaaggcctatatgtacgccctgccctatgaatactatgagaaggacaaggttcgccgctacggcttccacggcacctcccacaagtatgtctccggccgggctgccgccatgctgggcaagaagcccgaggagctgaagctgatctcctgccacctgggcaacggctcctccatcgccgctgtggacggcggcaagagcgtggacacctccatgggcttcactcccctggccggcctgcccatgggcacccgctccggcgacctggacgccggcatcctgcagtacctgatgaacaagtacggcatgaacatcgacgagatgctgaacatcctcaacaagaagtccggcgtagagggtctgtccggcgtcagctccgacttccgtgacctggagaaggcagctgaagagggcaacgcacgggcccagctggcggaggagaagttcgcctacgaggtgaagaagtacgtgggcgcttacgccgccgccatgggcggggtggacgccattatcttcaccgccggcgtgggcgagaacgacaagggcatccgcgccatggtgtgcgacggcctggagtatatgggcgtgaagctggatcccgccgccaacgacgtccgcggcaaggagaccgtcatctccgccgccgactccaaggtgaaggtcctgctgatccccaccaatgaagagctgatgatcgccaccgacacggccgccatcgtcaagggcaactaaattccgcatctccgcatattcagagagggcaggccgcaggcctgccctctgttcttttgcaaacatcccgtttcggaagcagggatcctgggaaagcgcgaggggagcagcgtccgccccgaatgggcgcaaatgccccgcaaagccttgcccccggcacagcggtatgctatactcaaaacacacccagcggaaatcttcgaaacgaggtgatcatgtatgcgggatctgcgggagtcctgccggatcgcggtggtccaggccgccccagtgatgtttgacaaagccgcctgcaccgtgaaggcggtggagctgatccgggccgcggctgcggagcgggcggagctgatcgtgttcccggagctgttcatccccggctatccctacggcatgactttcggcttcaccgtgggcagccggaccgccccgggccggaaggactgggggctgtactacgacaactccatcctggtgcctgggccggagacagagatcctgggccgggccgcccgggaggctcgggcctacgtgagtatcggcgtgtccgagcgggacgccgtcaacgccacgctgtacaataccaacctgatcttttccccggcgggcgaactgctcaccgtccaccggaagctgaagcccaccggcgcggagcgggtggtgtggggtgacgcggaccggcattacttcccggtggcgcagacgccctggggtcccatggccagcctgatctgctgggagagctatatgcccctggcccgggtcgccctgtacgagaaggggatcaccctgtacctctctcccaacaccaacgacaacgaggagtggcaggccaccatccgtcacattgccatcgaggggcactgctttttcgtcaactgcgacatggtcttcactcgggacatgtaccccgccgggctccactgcccggaggagatcggccgcctgccggatatcgtctgccggggcggcagctgcgtggtggatccctacggccactatgtgacccagcccgtctgggaccgggaggccatcatctgtgcggatctggacctgacccaggtgccccggagccggatggaattcgacggctgcggccactacgcccggccggacgtgctgaagctgaccgtggacgaccggtgacagaaatgccgaaggaggaagccccgctgtgaaacacatcaagcccggccgggggccgtcagccatgggagccctcggctccgtcatcgctgtggtcttcggcatcttctggaccgtatccgccgcctccatgggggcgcccatctccttctccatcttcggcgtgctgttcgttatcgtgggcatcgtccaggccgtctacaatttcaagaacgccgcgggcaaaaaacggtactccgccttcgacatcgtggacggcgaggaggagccggacccgctgaatcagcgcttcggcggccagcccccggaggccgtggacacgtccggaccggaggggcccctgcgctactgcccctactgcggcgccaagctgggggattcctatacattctgcggccactgcggcaagcggctgcctgacgtccaagaggaggatcatccatgaaaatcgccctgcaattcgccatgccgtcggagctccatgccctgccgggcgcccgggagctggcgccgctggagaccgtctccggcgttcccatatttgagattgccccggacattctggcctgtgccggcggcgtcagcaaggtgaacgctgccatggccgcggagctgctgtgcctgcggtacggcgtggatctgattctcaacgccggcgtggccgggtgcttcacggatctgcccaccggcacgctggtggtagcgtcggaattcgtccagcacgatgtggacaccaccgctgtgggggaccccatcggcctggtctccacggtgaatcaggtggccttccccacctggcagccggagcgctgtgcggagctgcttgcttccctgggctatcccgccgtcaccggccgggtatccaccggggattggtttgctgtgaaggggcagcgggcggagtggatccggggtaccttctcccccttgctgacggagatggagggcggtgccatcgcccaggtatgcctgcggaacggtgtccggttcgtatcggtgaagtccgtctcagaccacctgttctccgacagccaggcggaggagtacttcgacttcggccaggccctggaggccctgggccgggcggtgctgcccctggccaaggcacttcaaaaagctggcagatagaaaatggagcgcccggcggggatgatccccgccgggcgctcgtatcccgtcagctatgttccgctgggccgtccggctctacggtaaatacttcttcaatgggcaccccgaacaccttggcgatgttccaggccagcaccagagaggggttgtaccgccccttttccaggtttccgatggtctcccgccggacccccaccagctttgccagctcctcctgcttcaggcccagacgggcccggtgctccttcatccggttgcggatcacggctccagcccccagctctcccggaagccgtaccaggcggcggtcagggcgtagaccaccacagaggcagcccagccaaccgtgcagccggtaaggagtgcccgctggggggtaaaaccgcccagcgtcagggtccccagcacagcggccgccatcatcagcatcccgaccacaaacgcccgggaggcggaccgggccagctgcgcttccagcatctcgtcagacttcaaaaagaagtactggaagtccaccgcaaaggcgaagaagcccaggaatccccgcgcttccgtaaacacgcctgcgaaccccagcagggagagaaaacccagcattccatacaatatctgctttttcataagtggcctccctaatcagcgttccaaaaagcggtatatttcgctctttatgaggtgaatatatcatataccacttacgctgtcaagtatgaggctagcatgagcagtctccgcgcgtcaagcgtcaaatccccctgagcttgctttcccgcaagggcacgcaaaactcacagatatgcgctgagaccttcggatgcgcatatcgttctaggatgggtctcgtgccgtccacaggcagccgtgctgcgcgttggggaaggtctccccagaaatctgacacgccctcttctgtatgggggacttcaaatactgcccagcggccgccggcaacggtgcggaccggcaggccgcaggggtcttctcggccggtgaggatcatgcccacgtcatacctctgccggtcctccgggatctgcgccggatcgtccagagcgatgcccaggatcgttgtatcctcctgaagcagcgcatgttctctcaggtatcgtttgaactgctccatcagctgccggttgccttcgccatacccgccggtccggcgcatataggcgatctgcatgtctcccagtttctcaatggtcaagcgaccacctcctatatgttgattcgtgtccggccggacagcgaaatactacatagaattcaaatattttgcaagaacttttttaaaatgattgacttttcagattttggctgatatactaattgagccgctttgaatgggttaaaaagtgtcccaccgggaccgcccccgacagcgagcccgtaatgaaggagttgaaacaacgacatgaacgcaattatcgtgaccggcggcaagcagtacaaggtagccgagggcgacgtggtctacatcgagaagctgaaccaggaagccggcgacaccgtgaagtttgaccaggtcctggccatcctggacggcgacaaagccaccttcggcactcccgtggtggagggcgcttctgtggagggcaagatcgtcaagaacggcaagggcaagaagatccgcatcttcaagtacaacgccaagaagggttaccgcaagcgtcagggccatcgtcagccttacaccaaggtcgagatcggcaagatctccgtctgagtatgaccactgtcgtattccgtatggagggcgaccggatcaccggctttgaggcccgtggccacagcggctacgccgaggcgggcgccgacatcgtctgcgccgccgtcaccagcgccatccgtctggtggaagccaccgtcaatgacgtgctgggcctagccgcatcggttaaggttcgggagcaggacgcgtccatttcgctccatctgcccggagggctgtcccccacggcggagagcacctgtcagtctctgctggcaggcttgatggtttacttctccgcgctccacgacgagtatcccgacaacatcgaagttctggaggatgattgatcctccccatctaaaaatcttcagaaaggatggtccgtatcatgattcgtattggtcttcagttcttcgcccacaagaagggcggcggctccaccaagaacggccgtgattccaaggccaagcgccttggcgccaagcgtgccgacggtcagttcgtccaggccggcaacatcctggtgcgtcagcgcggcacccacatccaccccggtgtgaacgtgggcaagggcactgacgacaccctgttcgccactgtcagcggtacagtccgcttcgagcggctgggcaaggatcgtaagcaggtctctgtctacgaggctgaataaggaagccaaaccgccccggtcaaatgaccggggcggttttttgccgttatgcgttttcttgaaatggtccgtttcagaaacagagcgaccttctggccggcatcagtcaaagccagttgaggggattcaggatctccaggaaaaacatccagaatgtgtctttaaaacaggattttcggctccttttcccaggaaacagtgcccgtataaaggcaatcagcagacatagcaggagatacaggacagacaccagtatgaccagcaggatcacgtcctccatcgtacagcccccttctcgcagaacattttatagcgaaaccagtataacacagcctgccccacggcgccacagactcttccgccttttgattcttgtacacaggaagcttcagcagaacgcctccgctcttgacgtgtggcaggttttcggataaaataggcaggattaggaattctttgaatagatcacaatatgaggtgcaaccatggcaacttctttcatcgataaggcccgaatctctgtccgggcagggaacggcggcaacggttccgtgtcctttcaccgagaaaaatatgtggctgccggcgggccggacggcggcgacggcggccggggcggctccatcattttgcaggtggatgataatatgtccaccctgatggacttccgctacaagcgcaagtacgaggccggcaacggcgccgacggccagggggcccggaagaccggcaaggacggcacagatctggtcatcaaggttccacggggcacgctggtgcgggacgcagagaccggcgagatcatgcaggacatgtctggcagcgagccctatgttctctgcaaaggcggtcggggcggctggggcaacagccacttcgccactcccacccggcaggtgccccgctttgccaaggcgggactccccggcgaggcccatgatgtcatcctggaactgaaactgctggcggacgtggggctggtgggcttccccaacgtgggcaagtccacgctgctctccgtggtatccaaggcccagcccaagatcgccaactaccacttcaccaccctgttccccaatctgggcgtggtgtgggtagaggacggcgtcagcttcgtcatggcggacattcccggcatcattgagggcgccagcgagggcgccggcctgggccacgacttcctgcggcacgtggaccgctgccgcctgttggtccatgtggttgacgtgtccggcagcgagggccgggacccggtggaggactttgacgccatcaacgcggagctgaagcagtacagcccggacctggcggagcggccccagatcgtggccgccaacaaggtggacatcctccccccggactccgacaacctggagcggctccggtctcatgtggaggctctgggctacacgctcctggagatttccgcagccgctcaccagggcacccgggaactggtgaagaagacggcggagatgctctccgtcctgccccctgtcactgtgtatgagccggagtatgtgccgaaggccccggtgatcgatgcctccgccccgctggacatccaccgggaggacgacggcacctggatcgtggagggtccctggctgcggcaggtgatgggcaacgtgaacttcgccgactatgagagccggatgtggttcgacaaggtgctgcgggataatggcttcttccagaagctggaagagatgggcattcaggacggtgacattgtttccctatacgattttgaatttgaataccagcggtaaaatccaggggcgggccaaatggcccgcccctgtttttccaaaattcaaaacgaaaattagagaaattttttacgcttttttgtaatgaactcacaaagtttttttcaaagcttgacaggcgggcccagcgtgttgtacactcagcccaagttcaaaagcacaaaccaatgacgcggacgagtacacggacgtcgcttctccaagagagctgccggtggtgggatggcagcagaaggggccccgccgaatggaccgcagagggcgggctgaacgggatctctccccagtaagcgccgacgggcttttcccccgttaccagggaaagacgtgtgttggcacgtcgccgagtgggcgagcaatcgccaagttgggtggcaccgcagaagtcgcagacttttgtcccaagggaaccataggaatgggtccttgtgggatgaaggtctttttctttttctccaaagggccgcagatcagaaaggagcacaaccatgacattcgagaaaatcccctacaaaatctacctgaccgaagacgagatgcccatgaattggtacaatgtccgggcagatatgaagaccaagcccgcccctctgctgaaccccgccaccggcacgcccatgggcttcgatgacctgcgtccggtgttctgcgacgaactgatccggcaggaactggacaatgacacccgggagatccccatcccccaggagatccgggacttctataaaatgtaccggccctctcccctggtgcgggcctactgcctggaggaaaagctccagacccccgccaagatctactacaagttcgagggcaacaacacctccggctcccacaagctgaacagcgccatcgcccaggcttactacgccaagaaccagggcctcaaaggcgtcaccactgagaccggcgccggccagtggggtactgccctctccatggcctgttcctacctggggctggactgccaggtctacatggtgaaggtcagctacgagcagaagcctttccggcgggaggtcatgcggacctacggcgccgccgtcaccccctccccctccgataccaccagcgtaggccgggccattttgaaggagcacccgggtaccaccggctccctgggctgtgccatttccgaggcagtggaagccgccgccagccagcccggctaccgctatgtgctgggcagcgtccttaaccaggtgctgctgcaccagtccatcatcggtctggaggccaaggcggctctagacaagtacaacatcgtgcccgatatcatcatcggctgcgccggcggcggcagcaacctgggcggtctgatctcccccttcatgggtgaaaagctgcggggcgagcgggattaccagttcatcgccgtggagcccgcctcctgccccagcttcacccgcggcaaattcgcatacgacttctgtgacaccggcaaggtctgccccctggccaaaatgtacactctgggcagcaacttcattccctccgccaaccacgccggaggtctgcggtaccacggcatgagccccgtgctctccgagctgtaccatgaggggctgatggaggcccgtgcggtagagcagacaaaggtctttgaggcggcggagcagttcgcccgggtggagggcatccttccggcgccggagtccagtcacgccatccgggtagccatcgacgaggctatgaagtgcaaggagaccggcgaagagaagaccattgtctttggcctcaccggcaccggctacttcgatatggtggcctatgagaagttccacaacggccagatgaccgactatatccccactgacgcagaactggaggccagcttcgcccagctgcccaaggtgccgggacaagattgaccctagtcacgaagacagcggaggacatgttgtcctccgctattttctctgttccggtggtttttctgcataaatgtcgccggtctgcgcaaactggatccgaatccatttgcccagactggaggaatgtcttgtgtccaatcccaaccgccgcggcgccatggcgctggtgtccgcctccctgtgcctgacgctcgccgcgctgttttatttcactgccccggcaccggccctcaccgcctccgcccccatcgcggtccctgcggctgcggactgggggctatccttccccacagagggggaatccccagtgggcaatgcctctgcggaggacctggcccaatacggcgcctactacctgggggataccagccaaaaggtcctctacctcacctttgactgcggatatgagaacggctgcacagaggccatactggacgccctgaaaaagcacaatgcccccgccgccttctttgtggtggggcatatgatcgaatctgctcccgacatcgtccgccgcatggcggcagagggccacattgtgggcaaccacacgtaccaccacccggatatgtccagcatctcggacatggccgcattccagaaggagctgacggacctggagaccctgtaccaggagaccacaggacagcctctctccaagttctaccgcccgcctcagggaaaatacagtgtggagaatctgaagcaggcccaacagctgggatacaccaccgtgttctggagtctggcctatgtggactggaacacggacgatcaaccttctgcggaggaggcctatgccaaactgctgccccgcatccacgacggagccatcgtgctgctccactctacctccgccaccaacgccgcgatcctggatgacctgctgaccaagtgggaggagatgggctacaccttcgcctccctggaccagctgcccgggctggcctgaccacgcaccggaccggacgcagcgcccggcttcattctccccttgcttcctgccgcctgacatgataggatggtggagacgaaagggggcggcgtcccatgcgttctctctccaaatccaagtggatggaagctgttcagtcctacgtgctctatttctttttctactccatgctggggtggctgtatgaggtgtttctggaagtggtggtctaccgctggggattcaccaaccggggtgtgctgctggggccctactgcccggtgtacggcgttggcgccctggtgttcctgctggccttctcccgcctgatggctaagcgggagccagcgtggttccgctgggtgaagccagtgctggtgttcctgggctgcatgatcgccgccaccgccatcgagctggccaccagctatctgctggaggccctgaccggcgcctggccctggcagacctaccgagactacgctatcaactttgagggccgtatcgctctctccccctccatccgcttcggactaggcggactgctgttcctgtacgtgctccagcccctgttccaccggctggtccacagcctgtcgccccgggtgcgccgcggggcttgcatcgccgttctggtgctgctggctgtggactgcgccgtgctgctgttccggtgatgccgcctgccgcattaatcaaaagaggactgacttggtcagtcctctttctgttcttccatcatcttttccagatactgctggatgcagcggaacgtctcctcgctgaggtcgtgttccaccttgcaggcatcctccgaggccacctccggcgttactcccagaaggacaaagagcttggagagggtcttgtgccgaccgtagacacggctggccacttccaacccgctttcattcagagtgatgaatccgtccgcatccatcgagatataaccgttttcccgcagcttcttcatggcgatgctgacgctgggcttggagtatcccagctcgttgacgatgtcaatggaccgcacctgcccccgccgctgctgcaaaaccaggatggactccagatagtcctctgcggactcgtggattaccatggcgctcaacctttctctttggagaataaatcacttgccggaaaacgtgagccgcctatcggccgtgatctatttcgagcgggaaaggtcatgcggatagtggaaaaaagagagacatgctttaacatgtctctcttttttggtggagataagcgggatcgaaccgctgacctcttgactgccagtcaagcgctctcccgaaccatcgggtatgcaccccctgatggcttgggaaagggcttgaatatcccgccccggcaattgatgagagacaagttgcagtatagcatagaaggtatatgttgtcaactggacatacctttacgatatgtacccctcgccgtggtcgtggcgagggtgagagcttattgcgccatgggcagttcataggtagcgcattcgtcgatgctgtcgataccattcaggaactgctccacattaatgttgaattcaatcttgaccctatagtcccggaacaccgaaaccttcttgatgatgtagccgcagatcattttcttgacctccatcgggctttcatcaaaaatcttggaccaggacacgatccggttgaactcggccttcatctcctcgatcttagagtttccatcattcagttctgcggtaagggtcgtgattcgttcactggtggacagtaccttctgtcgggtatcctccagcatttcagtcagcacatcttgcggcagggcgcttttcccttggatcgccttcagcacctcggacttgagggattcatattccttattggccttggtgttttcggctctggcccgctgcaattccgagcgtatcattgccatctgcttttgaaccgcacttcccacaatcatgtcgttggaagctccctgcatcttgtcgaagacctgatgcagcacctcagtgacgatcccgtccagaatgtgcattgtgtatccagtctgtcctgtacattcctgacggcgccgggtcttgttgtagcatacatagcgaatacgctttttatggaccggcgtcccatccgcaaggcgggtggttgtcccgttggtagtgagcaccagccggcctccgcagtggccgcagaagatgttcccggaaagcagggattggcctgcggtattcagcggtactgtgcgccgctctttccgctcattggtccgctccagcatcagtttctgcgccaggtcgaattggtctggggcgatgatctggagggcctcaaaggggccggcataggtttctccgctccgaaggattcccttatagagcgggttgtgcaggatgccccccacactggcgtcgtgccagttttgtcccttccggtttttgatcccgtggtcgttgaggaagttggcaaggcgccatctgccgtaaccggacgaaatgcagaggtcaaacatcatccggacgactctggcctcgtcctcatcaatgaccagcatgtacacctcatgtttgcgcttgttgaggatgccgctcttttccagccggtacccgtatggtgcgtttccaccgcggaaccggccttcctctaccatctggccaagggccgttttggtgcgcatcgaagttttctggctctctccatcggcctgccagaaacggatatagttggtcaggcggtccgtgtgggactcaaaccgctgctctccttcctgtacgctccagacgcggacgccctttttagtaaaccactccacaacgaagggtgtttcatctgacttgcggcccagtcggtcgaacatgaagacaagcagaatatcgaacttgccctgctctgcatacttcttgatgagctgcagtttatcacggtcatcggcgctgactttataaccggatacgccagtttcctgctcctcgcccacgatgacccagcccattttcgccgcaaaatcgtggcaggcttttctctgcatagggatgtctgcctggttgttttcatcgtgatcgacctgcttgttggtggaaactctgtataaacaataaactctttcagccattgatatccgtcctctcatgttttttgtgtgagagggcggacacccaattcattctattcgattatcaaggttcccggcttttgccatacccattatctcacactacggccagaatagccaggggaattgataatctttttataaacaaatctgcagtaaatgggctggtgtgttgggttatcctgtactttgctcaaagtttttgggcctcatcagtctgccaaaagcgaatgtagtcaagcatgcgttctgcatcaacgccgtctatgatctctccctcatagacgctccaaacatggatgcccttcttggtaaaccactctgcgatgaatggggtttcgttgagattgcgtcccagccggtcatacataaagaccagcaggatatcaaactcaccctgctcagcagcctttctaatgcgctttaacttaacaaggtcatcagtgctgactttatagccggacacgccgatctcctgctcctcgccaacaatgttccagccttttttctctgcaaaatcgtggcaggcgttcttctgcatgagaatgctttcctgatccttacctctgtataagcaatagactctttcagccattttactgaccatcccttcatcaaatcttctgaatgcaagaccttcagcaagtcgttctatttctggggcattgcataggcgctcaggagagcctgctttactaatacagcaacttcaggattttctttttctgcaaagcagagagtgaccttatagccctgaaccgagatatgcatttcaggcttttcttcgtcgattctgagtaccctgttcatagtaatcctcctaaaaataaagcatcggctatcctaaaaagatagccgatgcttttcaatttctaattgtaactgcttagtggcgatagtccttttacagagtaggttcgattgactgcataccgatttcctgtacttggacgatatccaatgttggcagagccttcagataattctctacattccagtattggaccccattttccatctgcgcatcttcgccgcggtacaggatatagcgcccatggatgggaccaaaccgccgttccgtcctctggcatttatcctcatcgacgaggtgccggtattgaaagggaacctgtttgctgctgtgtttgatttcaaagatctcacaggagttttctttctggtcatagatgaccatgtcaaactcgccagcctcaaactgcagtttgaaaacacggtgatccttgtcggccgccttcatggtttccagcagcacaatatcttccatcatccggccacggacttcttcaaggatgcggcccgtgatctgcgttttatcatattcgctgagcgccgagaactgctcatcctttaacaaggaatggataagggcctgggcctgacaatatcgcattccaggctgtgtgaagagaatatgttccactggttcaattccggggtccgccgattcaatgggacaatccacaatcaactccaacgcggtaagatattgcttaatctctatgatgtgagcagttgtgataccgatggactgctcctccttgttccggatatccagcagttccatcaaacgccgggtgaccgcctctgtatcaatggcatccagcgcctctgtgcgcttttcggggtcacgctctttccgcagatttgcggcagtgagccgcaggtcatgggagagaaaatcatcggtcagcactgagatcaggaatcggtggttcatatcctctatgatccggttgatggcgctggtcagctctccagcttcatacagagagtacaggtggcggaaatgcccgcccgactcgtagcaggccagggagtgctggatgttcttgcagattgccgtgtcgatgtatcttcgggtggactcgtcatcccggaaggatgcatcctgagcattcacatcttcatcgtcaaaggccagctctccggcgcgtagtgtgccgccatatcggatgtactcatcaatgctgtcgatcccgagcagacggctatactcccgatatgggatgaaggtcgtgtggatggacttggcccggtcatacaattcttcatccattgccagccagaagcccagggagtccgtaccagacaggacgatcttcattcccatggtggcgaacacatcggaaaagagggcagccgagtcaataaagtcttccatcagcgtgacctcgtcgatgaacacatatcggaatcccgcgttaaacaacttcttgagatcccggttcatcatcgccatattgtcagtcctgcgggctttgatgtatgcgatacggctcaagtcctcctttgtcattctgccaatggcctgacggagcatggtgttttttccagtctggagcaggccaaagagcagacacacgcggtcatgacttctgccgtggaggtacatctccagttgctcaaagcagtcgcgtgaggccagtgcctttgatttctgcgcaacggcagccagttctttgccgatggttatatcggtttcgacacctgatattgatatgcttttcgggctgcttccactcacttatgcgtcacctcctcgccaatcacgccctgatatgttaccgctttctcaattccattcttccgccagaaggaagtcacggatattccggtgcttgatcccgttcctgctcatgtcaaactcgtcgagggatacgacatacttggggaaattgtcctggatgccatcgtatgcaccgaactcccgtttcaccgtatcttcagaggccagcaggtatgttacctgcacatagagtttttctcctcttttttcgcatacaaagtcaatttctttttctcctgctctgcctactgtgacaacataaccccgtcgcagcagttccatgtagacaatgttttcgaggatcaggttgatgtccttcatgttcccgccgaacacagcctcccgaataccgtgatccgcaatataatacttttcgttggaggccagtatctgcttgccctgcaggtcctggcgctttacctgatagaagagatatgcgtcacagcagtaccgcacatagttcaggatggtttctgccgcgacagtccgctgctcatttttgaaaaacttagccagagaggacgctgagaaaactgttccgacatttgcggtcatatacgcaatgatgcgctccagcaaatcaatatcccgaatcttgttccgttttacgatatctttgagctgcacagaattgaatagatctgtgagatactgccgggagggttcttcctcataccggaggttggccagatagggcattcctccggccagcagatatttttgaaagcattgctggatcgaatcgcttggtgcaattgtgtggtacagttccaggaattcagcgaaggagaatgggtaaatcacaaactccacataccgtccgccaatataagtggccagttcaccggacagcagttttgcgttggagcccgtaatgtagatatcgcagtccagcgccactcgcaaagaattgacgcacttttcccagccctctacttcctggatctcgtcaaaaaacagatacgcttttccctcgatgccctctgcccgttttatgatctcatcgtgcagagccgttgcggtctgcagatgggagtaccgcatatcttcaaaattgattgagatcatctgagacggggcaacaccagcctccgccagttcctctttgatcagttccagcatcaccgacttaccggagcggcgaatgccggtcattaccttaatcagttcgcccccaatgaagggacggatgcggttcatatacagttctcgtttgatcatgattggaacgcctcctttctatcgttgacctcagtatatcccatttacaactgaaaatcaactgatataatctaattttatcagttataacttataaaattagtcgtatgttggcgcaaacactgtacacagcttttcaatttctctcaaagaagcccccgaatgcactcactttccagttcaacgatgtcgcctatcggtatccttaagccatcaaccagaatcaatacctgatccgcctcatggattcttttcagcctcccggttgatacgatataccggccgccgtctttctttgcgtcgggctggaaccaggtcaccgtgatttccggccgctctttgatccgctccaacagcagttgctgttttgagtccaaggcagccctggcatcctcgtccagttccatgcgctggtcggtcagccgggccgtttccacaagggcggcgctgtggccggacagggccgcaaagggtgcgaactgggccgcacggtctgagagcggcatcctcgggtgcttggctgaggtaggatgcggcaagttgatgatatcatcgtatggtccggtcatgctttgtgacctccgatttggttgtttctctccctggctgtggcgccgtcctccagattcagtcctttgaggatggcattcttgccaaaacgctttttgatgtccagcatggtttcctggagttttctctcccgtgcatgggcagtgtcagcctcttttttctgcttttcctttgccgagtagtccgtaaacaggtcaatctgctccggcaaatcctccggcacagaagactcgtccagcaggtgattggcgcagagggtcagccggcgggccagcagggttttatctacgatccggtcatacaggctggtggctgccttgagcagctcctcgccggaggaagtatatccgtccagattgactgtaccatgagcatgcttgggaattttgcgcccatagcggtccgtggtgacctctccggtgtagactgtacccttgaggttttcgatgtcatagcctactgtgaggaccagttggttggtcgcaagccgcttatctaccaattccagcgccagtgcatcggccatctcctggatgaccagccttgccttttcaaatgggtatgggtactgcagaatctgcccggagacgatgctcttgttttctggtttgtatgccttaatgtccgcaatggtgcagggttcccagccccaggcatggtcgatgagcagttctgcgttgacaccaaacagtttatagagcagttcctcgttgtgataatctgtaggctgcccgatagaacaccgggcaatatctcccatggtgtacaggccgttggcttccagcttggcggcatagccttttcccaccctccagaagtcggtgagcggacggtgggtccagaaggagcggcgatagcccatctcatccagttctgcgatgcggacgccgtattcatcggcggggacatgcttcgcgccaatgtccatggcgaccttggccagatacagattcgtcccaatgcccgccgcagcggtgataccggtcgtctgcagaatgtcgaggatgattttccgggcaaattcacgggccgacagatggtaggtctgcaggtagctggtggcgtcgatgaacacctcatcgatgctgtatgggtagatgtcctccggcgccacatgcttgaggtaaacactgtagacgcgggtgctccagtcaatatagtgggccatccggggtggagccacgatatagtcgagggccagggaaggatttcgccgtacctccgggtcgtgagaggaagcgctggtgaactgccggccaggggtattccgctgccgttgggcattgacctccttgacccgttggatcacctcaaacagcctggctcgaccggaaatgccataagacttcagggaaggtgtgaccgccagacagatggtcttttcagtgcggctcaggtccgccaccacgaggttggtgtccagtggattcagcccacgctcgatgcactccacacttgcgtaaaacgattttagatcacagcaaatgtaggttcgctccttcatgcttcggtcaccccttcctctttatcttccgacgcattttcaaagccattatagcacatttgttctggttgttctattgtgaaaaaacaccatcttgtacccattggaaaaccagcacagaatgctgtgatttctaaagcgatatgcctccatctttctgccgcaactgtaaaagagagccgccagtctggaaaccggcggctctcttttgtcagtcattttttctctctgcttgttcctccagggcaaggaaatggtcgaagtcgctttcaaacatgcgatcctgcacaatccggtatttttcaaactcgctctctgcgaaggctttggcgatctcatgcgtcacccggccggtgtcgtggaggatctcatgctcattgaattccaggaagcgattcagccgctgtgaccagtcctgcatggtcatagggatatggcggcctgcctggtattccgcatagtccaggtacatggtcacaatgcgttccagcgcctgcagttcctctctggaaagatagttcttagcaatggacacatcatacttctgtatttttccgtttggatactgctcccaggaagttaagcccatgtgaggtttttcagcgttggctcgctccacaatcaactccgccgcagtatgacggtggatcgcccagtggagtttgttctgtacctcggaaaaaaacaggcgtgtggttttggctgatttatcataatccagagccgtggcgtagatgtcggtgatcttttggtagaacttgcgttcagacatccgaatctcccggatctgctccagaaggtggtcgaagtattccttggtaagtacactacccccgtttttcaaccggtcactgtccatggcccagccctgaatggtgtagtccttaacgatggtattggcccacttgcggaactggaccgcccggtcattgttgaccttgaatccaaccgcaatgatcatctgcagattgtagtgcttcacctggcggctaacctgacgggagccctcagtttgaactatccggaaattccggatagttgcctcctctgtcagctcaccatcctcatagatcttctggatgtgctcattgattgtccgaacatccacatcatagagagccgacatcatcttctgggtcagccagatattctcatcctcatagcgcatttccatgctctctgtactgtcaccggtagcggccacaaaggtcaggtattccgctgcgctggatcggatcgcctgttcttgtttatcgttccgcactgcaacgccttctttcttctgtatcaattccatattgggccagcagtttccgagcttcggcttctccctccggtgtgatgagggcgggataggttcgcccggcagcgttgatcagcccttcctctgaaagtttgttcagcaggtcgtgatcatagcccttccagcatcggcggacaaggggatacttttccagttcctttttcttgaccgcccgcatttccggtgtatcccgttcctcccaggaggtcaggtacatcagcatgagggtcaattcccgaatggttttcttctgtttttccggcattagcctgtcctccaatctttttgacttactaccatcatatcacaggacgggctgttcgtctattccacaatcattccgggatatacatcggaccactccgtatgcgtcattactccgctgctgggagcgcagtgggcgagaacgcagtccgctgtccagttgacccattccgagttcaccagagcctcttggtattcctcagtccagccacggactgtattatggacttattacatcatcattcctgtacatatttcttcgcctgtttcatcttccgcacccatcattcctataaaagaggactccatatactcgtcataagcccgtgcgtatctctcgtacttctcaccgccggtttctttcagaacggtttcatcaaatgtccataaagggtaggagcagaacccactttctttgtagagcccagtatctttagcaaatccacgattgagcagctgcggcgcaaagggacagttgtttatatcgacatatgcactgtttttcaagccaataaattcttcaaaagattttgtaagaatagcgaactgttctttctcatctgctccttggataggcatatcaagaacaatcgcaaggccaggcagttctttgcccataaaatcataaaccgtgtacaattccaccctcggctccaatataacgggcgtctcaaaataatctttaatttcaaatgtcattttttcctcctgataacaaaatatcacctatgctctaccatatatgtaaaatcgctttttccctttgtgtagcctatctctttgctcatttggcgtcttccactccgttcagaataaaagaccagggaatgctggttacccactccctgatccattgcgattaaaaacccagttcagatatcttttcccactggaggatgtatttctgatctatgattcgattctcatggtaatggccgaaaaaccagtaggcgaatttacaccgctggctgaccatttcaagaaagtccgtcagttcatccgttccataggatggattgatctcctgcaccacaccgctgggagcgcagtgggtgagaacacagtctaccgtccagttgacccgttccaagtttgccagggcttcttggtactcctccaagctgggcatctcctcctcccaccagctcacgcctttgacccggaacatggaccgcatccggcgcatcagccaatactggcgctcgaagtccggagcggcgggatcaaggattccatcctgaatatcatgggaggccgcaccgcccattgtgaaccaggcgaggccgccgaagtcgaagacctgtccccgcataaggtgcaggacatgctcccgcacaacatggacccgtccgccattccattctttttctggtagagtgttcagcaagtcaaaattctcatggttcccatccacgaacagggtggtgaagggcttcttgttcagccagtccaaccaatattgatctttctggcttccatcccacagtcctccaaaatcacccgcgatgaccacatagtccccccggctcatctccttctgctgtgggaagtatttgctcccaaagcgttggaagtcgccgtgagtatcacccgtaatataaattgccattccatcgcacctcgatttacagggtcatttgctgctgccctggcagtggggagctaatttctgcatcggttgccgtgcggacaccaggaccgttcctggttttcgttgtcaccagcaggccatcttgaacaagctgctccatcagttcgcccacgaagcggttggcaagattatgcttgccttctttatcacagagcctgtgtacagagaacttttgagcgacatttaaagcaaccgggcctgtgatatacaggtttttccgttttgtccggcaccgttccagaatttcatgtgtgatctcctcgcgcttggtctccaactgtgccagatattcctcatcggtaatatcccaatacctctcgtagcagtcgaagccatagcagcagaacgatttcgcatccttcagtagttcttggatggctgggatctcgtccatctctataataccactaaagttcatcggatgcagtataactcctgccagcctttcgtaacggtatcagatgtgctgtccccaccgggctgtagatcccagcccgcactctggaacaggctgcggctttcttcatgaaatttggcggcgtcagtctcagccggccagccggaatcgaactgatagcggctgcgaatccggaagtaaacttttcggtactccactcttgcttcacctcgttttcctattcccaagtgctttttcaaacaataccacaagtaaggcggcaacatctattcaccaataccaacagaataaatgttcataaattgacctattctaccgatatccttccaccagaccgacgctgaccccaagcgcccagtcaatctgtttcatctcggaggtgtccaatgctccaacgcgctctctgagcctggacttatcaatagtgcgaagttgctccaagaggataacggaaccacagctcaatccattcgcttgcctattcaaacaaacatgtgtaggcagccgcggttttcccatcttgctggtgatgggggctgcgatcactgtggggctgtggcggttgcctacattgttctgcagaatgagtaccggacggataccaccttgctcagacccgatgactggccgcaggtcagcatagtaaatgtcaccacggctgatttcctgtctgcaatatgttttcacagaatacacctcctcagcatattgggcttaatatcacaaaaatagggaccgcctccgcatctcccgcatctggttggaatggctgctcatacggcatgttccggtcagtaaacgggttttggacagaagcgatccccatagcttctgatattaagacttcacatttgtgttgtctttctttggcgcttgtattcgacactacttccccaagcgcaggagcctgtgccattggcatcagctccatagggcgaccatctgaaccgcggctggcttcaccgcgtcatgggactctcacccccggcaggatctctgtcggccgccctcattgcttgatccccatttcggtggggctgtgactggacggaagtatcattatccctggcggagtcattgcgatacagcttgccacaggctgttttttggacggatggacccgcttagcaccttatttggccgtcgttgatagaggggaaatccgtcaggctgtcataaccgaacaaaaatgtataggtgacttcgtttgcagcctgtaccagaacctctacagatggttttcgcgcatcctccagcgtcgcttgcccctgttcagcaggggccccgtcaggaaagtattcagacaatcggatattcggttttcaaggaacaagtgagaagcatttccttctcgcttgtataggggaaggtgtcggcattttaataaccctccaatttcaattttctaaaagttttttcaaagacttgagaatacggactttccgtttatgcactgcaggctgtgaaacgccaatctctcttgcatagtcaagttcactttgtcccttaaaaaacaacccctgtaccaatgcctgatccgcagcaggcaacgctgagatcgcttggtacagggcctctttctttatttgttcaaggatgatgtgttccggagtgttgatggcgtcaataaactcccggaaattttcataggcgccatcctgacttccgatcatcccactcgtctggatctcatggtcaaaaaagctctgatcattgtccttgatattccaccgggttctgcagtaagtgcgatagacctcctctgtcactatgacttcctcatattcctgagtgcaggtgttaaaaacaataagggtaaacttcccgttggattccatgtgcctttcctccaaatttcaagattttgatggcgaatcaaaatcttgaaatcaggggtacttggcgatataagcctcccagcccatgccggccctcccagtgccgggcagaaaaatagccggggacgcatttctgcatccccggccgatccccgccgccatattgcggcaggaatacagagggccgggacactttacagcgtcccggcccttgtcagctggtcctattcatttttgcgcatacctgccactgtactgagtatagcagaggcaaagtcggaagggagtagggatttcgtcggtttttcatcgggaatcagtcgggataaagtcggggcatctccaattcttcctgaagttccggcacagcataaccaaaaaggcagagggacaataagaagatcgcctcgcgctttcggtcatagaatacgcttcgctccatattcagctcatccagcagttccttttctgtgctgttgaaacggtggataaattgtttggtcaggatctcatagtaaagttcaccccggtcagggtatcgtttcaagcggagaagggcacggtcgatcacatccaccagcatccggttttccatcacacagcagacccgttcctcaaactcctgcagatccatatccggggcgaaactttgcagatagataagcccggtatcagcgtcctgagcgcccagctcccaggcgtactcatgcagttcctccacccgctcactgaggacccacaccacatcccggtagattttcaaaatcagctttacccggtgataggccagctggctgtcaaatccaagggtcgccatctgccttttacatttctgcaaagtggaactttcttttctcatgccattctcctcctcccatgttcgctaaactgcgaacaaaatgcatataacaaagcctgtgaacattggtgcggctgcgcccctctctcaggagggggcttgccgtaccaaacttatatgagattgcgtgtttccaaccgaatacgcatggcctgcttggagacttggaagatctgagccatttccgcaaccaactgctcattgctcctgcctgcacgcaaacggtaaaaacttcttttgatttgcggcaggggcatgaggagagcagtagccaaagcatccgcctgccattcgaccagaccgtggctttcatccaaagatgtttttccttcataggcagccacatcgcctgtgccggagtacagcttctggtgcaggacccagtgccccaattcgtgagcacaggtgaaccgcagcctgccgaggagcctgtccacacaaagccgctcctccaccaggattgttccggccttgactgcaatcaaacggtagcgtttttcatcttggtcgtataaaatagccgctccttcatcaaaaatcgtttccccaaggatgctcccgtttttgcgtaggcaatgatattccagagttagatcaaacttggtctctatgatagtttcaatgggaactgcctggggaggcccgtccaacaaagcgggatcatactcttgcaggatcttccgtccaatggtttcaattgcgtccaatcgatactttggtacagacaagaaaatccccccttagttctggcggttctgtagcatttccataaatgccttccattcctcatcggtagcatctacttcctttgccactctcaatgctgcgcggacgatgtcatgctggcggatatagtcaggcagatcggccggaaccgtctgcctggaatctgcggccagatccagcagcatttcatgctcctgcttatccaattccagaaaagaagagatccgctctacaaatgctccctctggcgctggccggcgaccctgctcaatatcacacaggtacccattggagataccgaggtgtttcgcggtatcccggagatttaatttggcctctttgcgccgtgtgctgatgaaagctccaaaggtcactggtctccctccttcatagagtttcgctggtttgcgaacatcttgtttatattataactggcacatctgttcgacacaagggcaaaaaagaaagcagaggccaggtgttaaaattccataacacctggtccctgttttagagaaacctgtgggcgatccgcttcatttcttccacacactcatgaggtgctatgatctgaatcccgcccataaatttgaatacccatccgtaaaaggtgccgcttgggtcgacttcaatgtttgccgtaaagtgttcctcgtcatatgtgcgggttggtacagcttctccataatggtctatgatggttttcatcagcttgttctcacagagcagttcaacagaaactgtgcggtcagcagcaaacatatcaacgatcttgttggtgtagcccgccacatcaaagtcttcatcgggggtaaagccggagggaagtatcttgatccccgacagacggtctactcgaaagtgggccatccgctggtgtttgtgagaaaagccaatcaggtaatagtggtcattcttccattccaaagcgtaagggtccagttgatagagataaccgccatgtttgagaactcgttttttctcgggcgtatattcataatactggaactgtatctgccgcttttccaagattgccgtttggatggcatcaatgatgtaatagacttgctcattgtccggtttcacccggctggacaggctggcgagctgccgaagctgctctgcctgatgtgtgctggtcagacggcataatttctgtaccagttcctcggatttcctggcagaaatgatcttcgaggatgctactgcgtctgtcagcattttcagttctggatactcaaacaggcggcttcccataaaatattggttttgggtactcttgaccaccacaatatcaattcctgcatcgatcagcgcattggtatccgcgtaaacagtctgccgcactgcctgaattcctttttcattcagatgggcaatgatgtcagatactgtggcgggatggttttcatcagtccgctcatagagaaactggagcaattccagtatccgcatatttgttgaattctgcatacttcacctcctcgattcttaaaatggtctattttgtatggtgtccagtcccaaagaccaggaacagggcaaccacacagagaagcaggcccatccaattccggtctatgatcagcttgattaccgccgcaagcagcagaccgcccaccaggagcacaacgccgttcattcagcgtcctcccgaggcatatttccccatgtggatgtccagcacttctctgggcggctggatcagcgcgtcctcatactggcacttccactgaatctcccggctcatctggccatccgccacgccgtctatggtttccccatcctgaatggggttatcatgctccaatatgtacgatgccacattgtaggcgtggtttaccacccagttggggtccatgttgtggaagtggtactggaggtcgggcaggaacagggtgctcatgcccaccgtgtcgatgagcatatcctcggtgccctcaatgttgaagaagcggacattgaccccgaagcgaatgaaacggtccgacccctcaatctggtgagaacgcacatcctccgccagaaacagcttgccgcagttctggaaatagaatgcctcacaggtggggtacagctccgccagagcctccagaaagtcggcatccaggttggcacgctccagcgccggaagcgccgcagccagcatatcggtggccaccacctgatatttgcactcccggaagatccgctcccggtcctcctggcagtcccacatctggctcatgaggaaggcgtcgaagcctttgcccttgaacctgtcgcatttcatcaccatcagctgtaccgggcatttgccgtccttgaattccgcgatatgctcctgtgcggcaaagccggccatttgcttatcataacagaagcactctgttgatccgatgtgtttctctatcacagcggtcatggtttctttgtccggcatgtccaccggttctttaaacaaaatctgaatgagataggggcctccgggctggggaccctttttatcatccaggttttgctggaaaagttgattgctcatttggtttcctccttcttctccgggaacagcttccaccggaactccaactctttctggacaaactctttcggcaggccccggggattggcaatgagataccatacccgaaaggtgcgtttcttcggatctgtttcctgctggtagagctgataacccgcctcatcctcctgagtccactgtcctgtctgccgcttggcctgcacaaagggttccaccacctggtccagttcctctttggtgaggcttgaggcccaggcatgatccacatcattggcgtgggagaggtggaacaacatcgaacccatccagttctttgccttgtgctccggcgttccgagcaattccgcctgacggcggtactcctccagctgttccgctgttccgtaccgttccaccatctgttcccgcacatggatgcaccagctgtaatcccccggctggataaagggggcacagaccggctggagcgcctctgctgggtccacctcaaagcggtcgataaagtcgaggtagtgagctttgatcaggggcagaaaggtgtccagcaacctggtgttcagccgcaggtcctctgtcagcatccgaaagaatgaaccgcctgttgtcggttctattttgaaagagtagagccgatcatctccctgcttaatgatacagctgaagcccacctccacatttccatagccgatttcgtagtctatgtagttgtagcggctccggtcaaaccagacctgataggtcaggccgtttttcattttctttttgaagtcgccttttttcagccgcttccagcccttttcctccagccccaggccgttccataggtagtccagaaactcctgaaatatatctgccgggcgtttttgctccacggtctccacctcctgacgaatcctccttaataatcaagcaggatgggcacctgctgttcctcggcaaaccgcatggcccgccagaacatggagaaggcgaacttggcaagagattgggtgtcatactgggtgtgttccgggatgtctgccttgctatactgtccatctgagtctacggttccgtctaccgggtatccctccgtgtctgcccagccaaggatggtatcctcatcggcctgccatgccagctggttcagcctttccagctccttccgcagtccgcccaaggtggcgatagcgacggtgtcatcggtgggcagagggccttggaacagaaagctgtcggtgaggggaagccaccaagtcacgccccgaaacagggaccacacccgctcctcgtccgatgcaaggcgggcaatcaagggatgctccccgaagatccagtccttctccacggtgggaggcaccggttcctcgtatgtacgacaggcggccaccagcagcatagcgccgaaggcatcccaatccggcttgtccgtgtaatagggcttctcattattctccggccagggggcgtaggggggctggtccggctgagaaatggcggccagaatctgatcccgccagttctccaccgccgcctgaacatcggtcggggacaattcctcgtcgtcggcgggttccccatccggggtgatgcggttgaaggaatatccgttttcctccgcccactgctgaacaacggttttccagttgtgagaatagtaccgggtcagcgtcccggcgtagatgtcaagtcccatagtgtttgcctccttttctgcttggtcaaagccgttccagggtacagtcgtgcccggaatggtctgtatccaaaatgatttccacaatggtgtccatcgtctcttttccgagattacggacgcttttttcataggccagccactggatgtggatgggttgtccatactcatgccgcccaaaaccgccccgaagaatatcgttgaaagcgttcaggttccgaccgatcttccaatccaagccacagatgaacacctgctccacctcgtcataaaaaccggccatgttagaaaagcggcgaccgtcaatggtgaacatctctctcatgtccatataaacggctcctttaagtcatatttctccatgatcttattttccaaggcttcataggcatccatatcctctggttgcgctggaatacccttttgccaataaccgttcccatagtagaaaaacatagcccagtaataaggcaggtcatggctgaacatcgccactcccatggcatcggccactggctctgccagcggtgagcgatccactatctgggaggcttcctcataggagatccccaccagctccaccagcaggtgcttcaccagttcacagaagctgtgctggttgaatatgacctgaccatcctcatctttgaacacgatgccatctctcaccataatattctgctccgtttcttactcctcgtccccggccttgaagttgtagatggggcggatgacctttaccacatccgccgtggggccgatgttgtccagaatatcctgcatccccttgtaggccatggggcactcatccaaggtggccttgctcaccgaggtggtgtagacctctgccatctgcttttgaattcagacaccgtgaaggactgtttggcgtccgcccggctcatcaggcggccggcgccgtggggagcagagcagttccaatcctcgttacccttgcccacgcagagcaggctcccgtcccgcatattgatggggatgagcagtcgctcgccctctttggcggacacagctcctttccgcaggatcatggcgtcggtatcgatatagttgtggatggtggtgaactgctcctccacatggagcttcatgcctttgacgatctcgtccatcatggcctgccggttgagcatggcgaagtgctggacgatcttcatgtcgtggatatactgctcaaacaactctccggacacataggccagggccttggggatgttggtttgcttgaggtttttcagtttcttcagttctttctggatctccttctcccggccctccgctttcattcgggcaatcagcgcctcgatggaggcatcgtcagtgcggttgagcaccttatagcccgcctcctggtaatagctggccacctccacacccaagtgacggctgccggagtgaaccacgatgtagagatttccctcgtcgtccttgtccacctcaatgaagtggttcccaccacccagcgtaccgatgcttttttccgcccggaggagatccacatggcgggcacagcacaactcactcaggtcgatctcattgaggtagcggtgggccttatcccggatggagaagccggaggggatcttttcataaatcagcttgtccagcttttgaagctccagccgcccctcccggatgcgggtggtctccatgccgcacccgatgtccacacccaccagattgggcaccaccttgtcggtgatggtcatggtggtgccgatagtacagcccgccccggcgtgaatgtcgggcatgagccggatgcggctacccgccgtaaattcctgattgcacagctcctgaacctgtgcgatggaggcgctgtccaccacatcggtgaagatcttggcctcattgtattttcctttgatttcgatcataatttcctcgcaatattctatggggcatggccccgtcaagtcatctcatacagcagggcagcgtcgccctgcaccagttccagatgggagcgcagcgtttcaagcccgctttgcaccgcctcggtgggcagatcccagtccggggcaatttcagcggccagctccgggaggtcctgctcccgcagagctgccagcagttgagacgccagctctccctccagcagagcgcagtccagggtgtcctccgtctggggagcaggaaaacggacatccagatccagttcgctctcacaccagtcccagatggccatatagaccgcgccggagcagtcgccgtttgacagttcctgccgccggccgtctttgagaaggtaaaaggatgcgatctgtgacatagttgttcctcctgaatgttattctttttccatcagcccttctgcctgcatccggatcacatagaaggcccgcacccagtccagttcctgctccatggatttctccaaagccagcaggtggcgctttcccagcctgcggtccaggagggcaaagatgcggacaagaggattctggctgacaaggcttttctcaatgctctggttgtcaaagatcccaaacgcctcatagaacaccttttggtcaaaggtgccctgctccagcgcaaaggcatgagcctggtcgatggcttctttcgcggagtcgcaatctttcagcgttgtggaccgcaggtgatgaaatttcgtccacacattctcaaaatagatgtagtagttgctccgcagtacttccacaccgtccatacgaatggctgcccggccctcatggtcggcgcttttgctgtaactggtggcaaaatactgaatgtgaccccggagcgccgggcacaggtaatcattctccaatttgttccggattccactccaagtggatacgcttgccatgttaccacctctcagtcacgatagatacccacgaccaggatatagtcatcatctccatgaaaatcctgacacttgttatagaagtctctcaaagttctaaattcggccaacgctgcatcccgattttccactccgttctgttggagatacttgtccaggaaagcatcttcatccacctcattgagggcagaaacgatgtcatccagatcctccaagagagtgtaggccacctgaccatcatcaacgaaatcaacacctacgattgcttggctgagcggttcatgagagatcggttctgtcccagggcatcccaccagcgccatgtggagctcattccacaggcggattttttcggtgtagagaaattcatgctgatttgccgctgttttcaaagcatcaaccgtattctcgccactgaaaacagcattcatgagttcatcttcagcaggggcgcttccataaaaatagtgggcaatgttttcagtgttcattgagatacctcgccagtttcttctccagcagttctgccatatcattgcagaggcgctttaccttgtcctgctcatgggcgtagtaccagatggtttcctctccggggcggagcaggagctggtcgccgtccgcttctttccagaactcgcccagcacacaataccgctcgccatgaatggtcagattaaatgttccagagagttcaacgattacgcctgtggatacattgatgcctgcggtcagcaggaaaaactcccgcacctgggacgggagcgtgaagtccagcacgctttcttgattcccgatctgctcctccgtggcggcgggtttgatctcgtcagaggggtccagcacctttgccaacgccttggagaacttggggtatcggccaaataactccgggttattggccttgaattccttttgcttttccctctgcacccgctcctgctccttacagaaagcgtccagctccgccagataccgctcctggtagagattgctggcttcaaatgctgtgccgctcttttccagaatggcgatggctctcttttggctgccaaacaccgggacccactgaaaaccgtgtcggcagggcttcagtttcagaaattcaccccgactcagcagggcttccaactccgtctcatgttcgtcccaccagttccgccaactttctggtgtttcccgcccctcgaccaagtccaggagtttttctgtcaatgattctttgtccataggtgtccacgctctttctccgccatcacttccacattactcggtagcacaaagctcattcatttttggaatcagtattttatccatccactggcaaacaatctcaaaggtattgttaatcttttcttcatttcctatatcaagatatatttcattgtctctcaaactgtaaaacagtggttgtgtgttgatgtctggtttggcataaccataagggtcgtatggacgggtgttgattatatagcaaacctctatgcttatgctatcctttgtgttcccgccgaatgaggaaaacgcaatcatataggtgaaatttttactgtgcctcgtaagtgttttgtcggattttttatacttgaagcctaaatgcccgtacttcccttgcaacttggttccaagcatttgcattgcttcgttaaagttcattgtgccccctccattttctcatcgtaaaaataaatatagttcatttctccgtttcagagggcgcaggaatagatgctcatggccccgtaatcggtgtgcaggaccagcccgctttgggtaaaggcaaaattcacctgccgcaccacaaaggggtcgtcaatagaggccagcagttggccgctgccggtatcccacagctctatgggggagctgccacgatcctgctgaacggccatcagactgccccttgtccgcaccatacaggtgtctgaaaaatttagcccctgccggaccgaaaacgggaaaggattggcaatctcctctccggtctgggtcagatagaacctgccgcccaccgagaagcactggtcatccggagagaagaagggatgccagcccgcattggggatcacaactttttgggcggacttcagatcgaccagcacatactcaccctcggtgacacggtagaccgctttgctctgccggggagagagcatcccgaagcagtaataggcaaaattcggatcttttgacttcttacattttaccgtttcccgccacactttcgtgttgctgccaaaggcaaagacgacgatctcctcgcccgtgtaccacagggccaggtcgccactgacatccagcatggtcttcatgctgtttttcttgttggcaaagggcgtgacctcatgggtgcggagcgagaactgctggagaagatagctgttgttcagaagaagggtgtcattggagcagaggacctgctcataggtcatccgcttggcacccagagagaccgtttcaaggctctccccgctgccatcgaagtgatagagggtctcgtcctcaaaatctccgaccaccctcgtcaggaagaagtcatcccttgcgggagaggcggccaggggcatgaagccgttactgtccttaccgacaaaccgatggcaccgcgcctgcccaacagcggcatcccgattctgatagacaaatcctttccgcatctggcccatcatggcgctggcagccttgctcctgacctggaaagcggagtcgcacaggatctccttgaccttcccgccattcaagcaggttcggatggtatggccgtcaatttcaatccgccactgcttatttgtagtggggttgaggaaggttttttcaatcatggctttgactcctccctttgaatcaggatggtttttccctcggcgttgatgtcataaaggtcatccaaatggatatggaagccatccacacgagcggtttccgccatccccagagcggctttcgccaacaggagcagccccgcccggtttcccgttaactccaattcatttccatcggcatgggtggtaaaggagaggtaggcttccggttccactgggaggataggcagtagttcgtcattcagttgaatggtcagtgttctggttttcatcacttaccgaaatacctcccatcaatcccaccagaaataccagacggtggactgccacaggacatctgccaaggagccaatgcttccatcctcattctgatccagatctgggcagaagccatattgctccacagccacctccatagctctttccttggagatcggagttggaagttcaaactccaattcatcgtggctcatggcggcagggatggcaccatgctgctggaaccagtatttggccgcagccatcagctccggtgtgtcggggcagtcattccagtttccgaagggcaggtaggcgaagatctcccaaggattcttcaccgggatcttggccagaatgagcggataggtcatctcagtatcatcatcccagtagctggagaagcggtcattaggttctccgccctccatctcgcccaagacttcctcatcccagtccatatcgtcatcttcggcttcttccttgcgctggccggtcaattcctccaaaaccgtctttccgtccttgacgggggtagagagcatcttcttccggtactccgttacagctttgaggtcaaattcgtaaatgtctacatcattcttcgggtcggcgttcattaccagacattccaacagcgtttcatcatccgcctggataagcacgggaacaaagccctcccgtacccccagccgctgggcgtagctgtatgccgacatgatggggtcatcatctgccatggatgggaaataggtacactcgcagtccaaatactccatgatggcctgagccacctcggaaggctccagtgtgtcctcgtcgaagtcctgtccctgccagttagcaaagcgttcttcgatcacctctgccatagcctgatagtagtcctcgtcaaaggggatgaacaggtaggcttcatcttggaactcatcggagtgataccgctctgggccgaagaagcagagggcgttgtcgtcaacatcggcaggatagtagggactgtcgccctctccatagtaatagcccgcaaaggcacggccttgatgattgaacagcacagagaacagacagccgtccagctcatcccggataaactcccgcagatccacgctggcagaatcagccttgaccttttctacgacctctccgtactccgcaaggaattcttcacccatcaggtcgtgctccatgcaccagcgcaggtagatggccatgtggttataagcattgatggggtcaataggcagttccttttcctcgatgctctcgatgtgataggaagcatcgtccatctcaccgtcaaaatcatcattggaaagggtgccacgagtgatagcatcctggcgggtggggtttactacaaaactgatccccctcattttgttcagcagagcgtctgtatcatgttccagtttatagtccaactcgtcctcataaagcggaatgacctgatagaagttgacctcctcgccgcccggcagggtgcagacctcgctgccatcctccgtatcctggggaccgatcagggtagcagtacacagtttggtgttgtctgcaaatggttcccggttctccactgtatgaccatgtcccaaccaactgtcacagttgatgggcagacgggccaaggatttcagcaggcggatgggccagtaccacttttcgtctttcatggactcctgatccagcttccagtccgcaggcagcgcgatagccagctccgcccgctccagcttatattccaccagctcctccggcacattcatccggtgagcgcccatacccatggtgaccagggtgcaatagtcccgctcctcagtgggcggcaccatgcagatgtccacatggatgtctggagaaaccagctcgtggaacacattctcgaccttgccgaaatactgctggatgtgtccctcgacggcctccatctcctcctcggtgtagacctcgggaacaccggcttcttcatcctcgggcatttcgccgtccgggtcatcgccgtcatcgtcagggtcaccgtccgatgactcccaggagattttcagcgtcatctgctcctccggcagaccgacgccagggctgcgggtgatggtgtgcttatcatctgccgcaaaaccgatagtttctccatcgtggagttccacatcgttctccagcacataggacacaaggctggccaaaaagtcccgcaggtcgctcggcttggcatcggtgcccagcacctccatctcgtctttgccaaacacatccatgccgtaggtgtagccattcatgccattctcgtttctccacagaccgaaccagatccagttgaagatgggtagttcgccgtcctgcatcatgtcggcaaagccctcatagaaccggggttcaaacaccacgccgctggtgtagatgccggtggcatattcctgacggcagcaggcggcgaccaccttggtgtagagcttgcccttttccagcaggttttcctccttgcccagcaccgccaccatgatgtgggcacagtgctccttggcaaccttgacggcgtcctcccacatatagttgttctcggcattcagttccgcttcgccgttggggatgggataggtcgccaggctgacggcggcgaccatgtcgcccacttcgaacaccagcgcgtcatcgtccttctcctcgctggcatcgtattcatccacggcgatatcccacttttccttcatgtcccggatgaactgctctttatcccattctcccttggacaggaggacaaatccggtgaaaacgcctgtgtggtcactctcatcctcggcctctgcctcggcccgctttgcgatctctttctggcactcttgaatcaccgccggggcatccttgtcttcggggtccagttctgcccaccgctgggcgtaggggatagcctgttcctcctgcccatagagatactgatagccgtaggccatccgcatattccactccgccttgtcctggccttcctcccggacggactccagtacctcaatggcgcggcgcagggccttgtctcccttatagttaggagtaccctcgtcgtggtccccgatgatggcgtaattctccagcgcccgcgccatggcgtaggcaatgcgatagttccgccagtcctccgggatggcgttgagggcctggatgcagcgggtgtactcgtcctcgtcgttccactgctccagctgctggaagtattcttcttcgttctgcggggtgtaagggatataatccatgcccgccagcgtctcgtccagctcgggggcctgatcctcatcgtccggttcctcctcggacggtgtttttaggttcactgtgcccgcctcccggcggaaggtgtggaaactggcccaggggatatcgctgtcctcaaagaaatttttggccatctggagcgccgtctggatgtcccaggcgatgaaatccacatagccgcagtagaggccggtggctcctccagtgagagtgagtacctccggaccgtcgccggtggtgaacaattcctccagcttatcccggaagtcgaagatcttctgggttccttctttctcccgcagggtatccagagggtagcagaagaagcccgccaccgcgccgtcagcatggagatcgtccatgaagtcattgtcggcattcaggtagccgttgatgagcggcacacagcaggtggaaccggccattacatccagccgccagtcagcgtcggggtcttcattgggtttcatttcgtagccaagatagctctccagataggcttctggatcggtagagagttccagaccccgctccttcagagcgtcgggaagctgggacataagaatggacggctccgccctgggttcctccagcacatcaaagctgtctatgtatctcatgtggggaatctcgcccagcacttggtcggtgagggtggtgagcatccaccagacccggccttccgcctcccggagcatgggcagcagcttttcacagtaggcggagagggcgaagctgttttcgccctgctcctccagccagatctgcacatcatccccggagatgtcccatccatcctcggtacgcagaccgatgttctggaggggctgacggcccacaaggatgttccagtgctccagcacctccttgggggcgtgtttctggaagtagaccagctcaaacagcttgaccttatcaccctccggggtgaggatcagctcgtacttctcgccgttgaagcccatctcgaaggagatttcatcaaaggccagattcagggtttcctccatttgggccacgagttctgcaccgcgggtgtgatccttgtcgtcatccatcatctggcgcaattctgcttccatctcggcaaaggtttcccaccagttctctgtccgatcccggaagcactcccagaactgcggcagagaaataccctgcttgcaccggtcgataaactctttggtgtcatcgtcaccagggcggacttccaatgccttttcaaaatatcgcagagcccggccctcctgatccagataaaagtaggagtaacccatgcggaagttccagtaataatcgtcctcgaagtattcctcatggggctttagcagagcgagggcctttttgagcatttctttgcaagttggcttatgtgggtctgccagattgttataggcacgggctaactcactgtccatctcaggggtacgctcctcggcggggatggcctccagcgcatcaataattttatgttgtttgctctcctcatgccacttctggcactgcttcaaaatgtccatatcagggtcctcctcgtcctcatccggtttccagtctttgatctgctggaacacaccgttctcatcccgctcaaaggcgcagggggcgggggtgttcagcagagaaatgatgtcgggatcgtcgttgcaaattgtgttcagcttgtaaatcccggcattgttggggtcgtccatgtacgcctcgctctcgtcaccggcggtaaagcgccagccgctgtcccagccgccgtccggattctcccggtagcagtagccaaccttgtagccctccatcgtaatgcggttggtggcgatacagccatcggcgccctcccagtcggggagcagattcttcatgtcctctgcctttacatagtagtcccggttgcggccagcggcctcgtacagctccttccgcagcgcctccacatcccgagccatctcctggatctcctcgttatccatcatctcgctgaggtcgtattccagcggggcatggacaaagtccgccagggccttgttcatggcgtcatgctcctctggcgtagcagtgatgcggatacggcgggcgggggtgttgtactcgtccagatcctgaaggtttacactgccactgacgctgcactccagcaggatggcggccaggtcggtgaccacatcaatggcgaagtgaaagtccatctccacaccatcggaatgtgtaaactccaggtactccacggtttggcgaaagtcccagttctgcttgtccagaccgatcttggagaaaatctcgctgagggggatctcctcctttttctgatcctctaaaaatgccacaaggttcagactgtcatcggaaccgccaataaagttgccccagtattttttgatatacatttgtcgtgcctcctgttctgaatccagtcgatcaatgagctgattcaagtgttccaaccacgcaggagcgatctcaccgctatcctcgttcttccaaagatccataatctcacggatgccgtcctcgtccggcacctcgtttttgatgtcggtgagctgccgcagcaggaaagcaagtgcttctttggatgctgtgaaaccggtgactttatcccatatagcttcttcatgatcgtagtccagcttgccgttatccttccattggaaatacagctccgccagagccatcgcagtattgtcaaagagaaagtcgatttgtgagaagtcagatcccagcatgacttcctctttcatcagttcaatcatctcgcccagatccattaccggatgctccggtacatattcatttttgaggatgtccagtacatccagcccttcgtcacgctctaatgcttttataccccatgctcccatgtcggcacctctctttctttatttcgtatcaagcttctattgtcaatcatggttctccacccggataatgggccggtagaagtcataatctccgtttagttccttgtcctcctgcacttccggcttacagtggggcgaacagggtaggaaaccgagaaatgggcccagcccgccgcagatattgcacccgccgtcaccgccgcaggtggtaagtctatcagcctgcaccacttcccgcatatagggatcgtaggcgatggacaggccgaagaagttgggttcctccatatcatagggccggttctcatcctcatccatgtcctcaaaccagcgtagacgcatggagtagtctaacccatctccccatgggaacagggtccgacatccgccgccgcacaggtaggcccactcgtccgctgtgggcagcgaaagcccctgcttttccagcccggcaagaagcgcatcgtagtctgtgcagtgatagatccaggtatgaaatccatcttctgtccgttctatgcgggccgactgatgcaaggtaagactgctgctgtcactccaagcaaaatcacggaattccttcagccagtcagggtgggcagtcagcctgggatcgtccatcttgaccggctcccagcacagttcctccagctcccggcccaccagcatggggccaatgaccgcctgccgaacgggagccatgctttcccggatcatctcttccgggttctgcggttccatctcccactcctggaacagatagtccaattcctcccggctctcctgattcagtccctcggcaaactgctcccagcccagggtgacggtatcgccggggacaaagacgaactcccgaccatctttcttgaagatgccggtggtgcagctctggccccagtggtcaaaggtatgtagaccgagaaaggtcatagtataacgagcagccaggctttccatcagcgcctgcttctcggtggtatccatttgattgaattggggacgggacagtttttcgttcatggaaagtcctccttcgattcgttttgcgtgttccagcagatagctctgaccatcctgcttggcccattccaagtattgtggaagctggtcggaatggatggcatccagtgaaatcagaacggcgatccgctggtattcctgaagttcaggagagtaacagttgcgctcccaaaacagcggagcgaactgttccacacagtcaggacgcagagcaggcatcgccaaaagcgcccgccggctcacatattcattggggtcctttgcgaaatccagaattatatccctgactttctgactacatgagcattccggcagataggcggcaaactgccacttggcctcattctcattggaagctgcggccctgcggcagaggcactcaaaccattgtggatgggaagtggtctcctgtataaatccctccgcttcgttggccctggcaattaaatagaccatctcatccagtaggacgctgtctgccgtttctgcatccatttgggtcaacatatggcaaaaggcactgtaagtatcattccacgcagggtaatcgacctcccatgcaccgccgatctcctcggtggtttttccgggataagtgatttcctgccactgatgaaattttcctacctgctccagcaggcactccctgatgtcctttgccatacgcttacctcacaattctttgcacaggtttcccagttccaatgcctgttccacaaggcccaggagcaggctggaaaaattctcggcaatctcctccagatcggcatagtcacagttatagccccggactctgccgctctctaagtcgataaatacgatacttccgtcacccaatcctccgattggaaaggtggggccgtggtcatattcgctcatgtaatcctcataagcctcttgaaaaatcgggtaggcttcttccaactctttcagtgtgaagatccacggctccgccaaatagcagccgccgaagttcaaaagtagccagcggtactctgcggggatgggagtatacctgctttcaaatcgtttcacagcatcctctggttccgggaagataccctttgtgaaggggcttactttataagcagtttgaattttactgcggtatttttccaaattcatgtcatgcattgtgtttccctcacagagcatccagattttcctgtagatcgccctgcatcaagtgttgggcaatggcccggttcaattccttatgggggtgataagcggcctgctctacatcgtgcaggcactcctccatcagtgcctccggagaaatgccttcctgttttccataaaggtgaccgaaggcatagcacactgatttgagaaagccgaaaatatagtcgtgatttccacgcatactgggtaggtcattgaacgagcccatacctccgtatgcccgaaggtggtgggaaacctcccgccgctgggtccagtcctcaatatcccgctccagccagccgatccagtttttgaattccgggtggtctgtctgtaaaatcgaccgcagacagatcagagcctccgtataaatatcggtctgtttcataggccatcgccccccaaaatacctccatagagaacaccgtttttcccgaggaacagcatctggctgcgaagtaggctgcactgctccacagcgaccttgtttccgtcacaggtgggaatagcctcctgtttttgcccaagacgatcaccatgagcagtaaggaagtagaatttgtcccgttgctggtatccgccttgaaacaggaaggtattgccggacggggcaacagaaaaagctccgcttccttcgattggcagttcaaacacaaagtcctctttgaagttcgtccgcaccagccggaattcatcgtaataataaaaccacaggttttcttcttcgtccaggctgatggcgtagcagtcatagatggaatacttctcattcttccagagaggagttccatccgatgtccatgcaatcaggccgcaatcacccagaggttcatcccaaccgtaattaccaaatacaccttcatcaaagtagctggtaatgatggtgccatctttttttaccacgcagtcttgaatgccatcccccaggcagaaacgggacagcacagctccgtcccggctgacgatccaggcgttctggtcggggccgttttcccgataggcgcatcttgctcccagcaggaggaagtgttcacctgcaggccgcaaataatggaactggaacttcaagagaccaagaggaaacagcgtcgtttccagcacccgctgttccgcccaatccaactggatttccaccgcggtataggtggaaggaatgctgagccagtccttaccctgtgtttcggagggctgttccatgagaagatagacttttccatcccttgccgtgaaaaagtctgttacttctgtgccctccagatggttttcccggcgcagctggtccaggtcaatgatggagaacaacggcagattttttgcttttaaggatttgttcattgggactcctcctggttactttaacgctccatcataggtgtgagtttcccagatggactcaaattctgctttctctattacacaggcgtggaactcctcaccccagacatgggcgttcaactcatccacggtggggatcggtgtaatctcgatggcgccgtcgtaaaggtcagggatgttgcgggtgcggccatctgcaaagatgtcgatggagcggaggaccagccactcattttcggtatccacttcatagaggatgaccgctggctctccatccggtgcgccctcccaaaagagtttgatgtactcgatcattccatttccctcatttgaaccaatgccaccccgtcatggtgccggttacctcatctatctgtaccgcaatatcataattgccgcgacagcccagcaaagctgtaggatggtcgttttccagaatcaaatcataaaactcaaccgctatgtcttggaattccttcggaatctccagtgcagagaagaaatccactgattgagcattttggaaaaattcaatggccgttttactgcattttactataatccctgtttgagtggtcaactctttcatgctttcgcagcctcgctcatgttcagatacatccccatcgttttttcattgtcacaggccgcccggatcattttggacagtagcatcaaatcgtcgatgtattgggagtacacgcagaacacatcctcgtcggaatcaaagtgaaacagatccacgccgctgttattttcctcgaactcctggatcacgccccggacaagccgctcccaatccgcgctgctgcctgtcagtcccagccgtcggaatttctctgtccggaatccgtcgctgatctttagcagaagggagatcgcataggggtggtggggaatgagaaagaatggcgcgatctgctctggttttacccagattttgaagggcgggcgcggatcaggtatccagggcaagatttcccattcgtcatcccgacgatttccgtattggcaaaagtctttcatggctttgcctcctgtttgagtctctttctgcatttctcaatgtgggcctgtttggtggctatgatctccagcaccttctctggctttatccgcagcagaagcgcaatcttctcaacaggcatcccgtccgctgccagcatacagagaatttccttctgtgcggaggcttttccagcagcaaaaccagtatcatagtcgtgagacagcagggcaaagaattgctccggtgtcagagtggaaatcagttcctgctccccgtgatagatcctgctgcggagcatttccagttcataaagtttcatttctgccatgctgtactccaatcgtcaaatcggtctatgtaatcctccccatagcccatgcgccagccaatggagtatcgctcgatctcccggtgggccagccaaggggcggcatgattttcttatcttgtagtgccatattgttttcctcatttttctttcaggcttcgcatccgtttcatgatctgctcctgttttttcgcggttttacgctacctgctcaaaaatcccgcagctgttcaaactgctccagcagggcatctttctggagtgcatcgcctggcagggcatccaggatcccccgcagagccatgtaaatttcatcccgttcctcggtttcgataaagcccatcttgttgaaggtctgagtgtaggctgccaccgcctcaagtgcctgggcttgggcgtcctcgcccggctcagcggccagcttcatcagctgggaacgggtcttgcggtattgattggctgcctttttcgcagcggcggcagggatatgctccgcaccgtcccagccccggaagggattgtccaggttttgcgccagccactccggtttccgggccttagtgatccgcagatccattcccggcttgcttttccagagctgctttgccgcttttgccgccgtctccggcaggctggtcatccagaaccagcgaagctccggcacctgctccggggtggggatgtcagctgcgccgaagccgaacaggtcgaaggtggagaggttcgtcagttcccggaaccctcccacggcggagaagttccccaggtttcccggcgcgccccagagccgcagttccttcaggtggggatggacagcagccagcccggtcagatcaaagtccttcagctcgatgccatgcagcccccgtaagttcggcagttccgtgtgcgggcagtattccccgataaattggagggtcaagccgctgccatcttcggggcatggatggtacaggcgtccggccccttgttctgaaacaggagcagctccgttccctcacacagccacagctcctccagcccggtcatgtccagcatcagctttctgatgctggtgcctcgcagatcaagtgtcctctgaccgtggttcagcagggtcagctcactgataaagggattccccctcagaaactccagcagatccgggtgccaccgctggcagatgagttcggagaggcaaggcagcgcctttagttccagcgccgaattgaatggcgcgtactgatccatcacccgatgactgctgaccttcaccgggataccgccgatctccgtttgctcatcgctctccatggcctccttgaaggcccgccgccgctcctccgggatggcctgccaccggatctggagatacacatcatggccgtcactccagcctccgtaggagcagcagggctggtcggtgaagggcggcagagtccccaccagcgtgtactggggcgggacctccaccggcacccgcagcagatgaaggtcacgggaccagtacatgaagtccttgtagagcgggcggagctggggcagttcctccgccgtcagaggggcgtcacccacccagtccagggagaggaccaccgcccagggctgcttgctcaccgagtccggcggcgcaatataggccacctggcaggcggtgtagcgtttcagatattggttgtagactgtatagacctctccggcggtggctttcatggcaccacgctcctctcatcagttcttttccagatagaatccccatatgcagttggagaattctccagcggcaaagcggtggatctgcccgtcaatctccacctgccagacctcgaaggtatggtcttggtgatagatcgggtctttgacttttactcgcttgccggtggtttgccagtcgtagtcaaagatgttcacaccgaacaatttgcattgaccgtccggaccaaaggttttatattccaaagccatgtgatgcctcacaattccgagcgctgccagccgttcagccgctcctgcaccgcgtcgatcatccagccctcgcccacacgcttcatgaggaagcggcggtcaaagccggtatttttctctctggtgtagatgcagagcttgttcttggtgatctgctccgcgtcaaggaattcttcccctttgtaggtaccctgggcactgtatgagaggcccagaggccggtagcccgggcggggcttttcgctcacatacttttcccagattgccagcaggcggggcacagcctgggcatcttcaaatccagcctgctccatatactgctcccactccgtcatctcagcaaagaaagcggacagcaccctgcggcattcttccaccgcctgcttatccagctggacgggatttttggccttttcccgctggagctgggagaagtgttccatctgctccttggtgaattgcatatgggccaccggctcgatgcggttgttgccagcgatggccagcaggccctcataggtaacggcggtatggtcgatctggatgtgggagagcttggggatggaggccgcctggagcagaccggcatcatccagcccggtgcggttgagggtgagaaggtccagcttgcagccttgcaaggcgggcaggccgctgccgtggatggcggcgttgccgtccaacaaaagatagcgcagtttgggcatagcggagaaaacagggaaacaggcgtcggtgagggcgccgtcctccacgccgaaattgaccatgcttttgtgaccagcaaagggggcaagcagttcatcggtcacaggacagccttttacatgaaagccaaccagggtgtacctggccagccgctccatgatctctgcggtcagctccggggtctcaaatttcttttccctatccagggtcaggacgccgttttcccagtccgccgtccgcgcccgttttggccattccattactgttttcctccttacgcctgctccttgtagctggcttcaatgtcaatgaagcgcacatacacggcgcagacttcgccctttgcatcatagccgaagtagacgggatagtaaccgtcaccccagccagaggagaagatgggcaggttgcagtccgtgtccggcacggtccagttgagccagtcgccgcagtccccctgatatttggggtgggcttgggcgttttcctccagtaagtcgcagaacaggtcgttgtaggggtcgatgtccgggtcctcctccagccgcttggcccagtatgttttgaaagccgcctgggtctggatgtctgcaatacaccccattccggcatctacgccgaaaccgaagtagtcatcatctcccagtgccgcgtccagattctcgttgcccaccatgcccagttcatagcggacaggcttttcccggctgacctccaccttgacgcaggcgtagcggtcgccgtatttttcactgggcaccacgcagatctttaccgggtaagtcccggcggggatcgtttgaaggaacggcagagtgtcctccagctccaccagcggatcacaggcgaagatttgcccggtggggaaatggacggtgccgatgtccagcacatccaccgccatattcccaatcactttttctgtaaaatgggcctccaagtcaactttgcaggtcagtttatccttgatggattcgtatttgttcagccattcggtcgtaggcatatcagtttcctcctgttgattctgcttcttgatgtacacactctttgagccgtcccagtagcagttcacacaccggccatcctgaaaatgatggtcacaattcgggtagccgtagagaatatgggcacattccgggcacagccccatcatctgtgaggagcctttgaaaaacaggctgccgcactcatcacaaagggccagttctttttctgccatagggctcaccagtcccgttcccggatggcctcctcagtgtcaatggggatgccaaaccactccagaatgtaggccacggttgccgcaatacattcccgcgccaccgtttcgatctcgctgtcgttctcgtcaaattcctcctgaagatcgttgatgccgcagaccgcctcgtccagcgtttcctgcaccgcatcggtgtcggtttcgccgctctccaacaggtcgatgaccttctgaagctcgtcctttaccttgttcaccagaaaagcaggatagtaatcgtcctgatacatttcgtccagcagtttgtaattggggtcaaatgctttcatcgtgatttctcctttctcattcaaacatcaaaccgtatgattcagtcaggcttccatcgtcctcgtgaaatatacactggtacacaggctcacgctgggttgctttgcggaaccgctccagaaccggagccagcggctcaccggtagggatgccgagggcatcagacacccgccgtaagctgtccacatccatatcttccaagttacagttgcgctgtctctgcccatactcctccagtgttttggaatccacatactgctttgcgtcacagcagtcgtgccagcagatacagctcacaagcagggaaaagagatcatccatgctctcagccagacggccagcctccccttcgctgctgtaatatccaatggaaccatcttccaacaggtggtattctccgccggagccatctctggcaaaggccatgccgggcattgaaaaggtgcatcggccttccgcgtcatcccgcggggacaactcatccagcaggaagaagtcaaacagcgaatcaaattcatccgccaaatcagggttttcgtgcaatatcttcaaatagtccatagccgttttcctccgtttacggttcttgggtcatttcgtgcagccgttccagccacagcgtttcttcgatcatctcatcattctggtaaaaatggtctttgtcgcgggccagatgatcagcaagtggagccgcgtccagcggggtacataccacaaaactgtcccgatccgcccccttgatctcccggttgaggtagtacacccgcctggcatcgcgggaataccagtgcccaagcagttcccaggaagtcagctctgctttgggaagctgtttgccgtaggcatatatccgcttctcatctctggcaaaataggtatcgcccaaggagcggaaagaggacacctccgcgcccttgatgaccttcaccttgccgtctccgttgtggaagtagacctgccggctgtcctttgcatatccctggggcgcacccgaatcgttctggccgttgtccaacacctggaaagctgccagctctgcatctgagactctcccgctggtggtgtagacggctgttttgtccatcgcgtaggcatagtttaacacccgaaacgatgccgggtctgctccacgcaggcgaatcccgccgagaaagcaggccgcagaggatttgccccagtaatgccagcagcagaagtctttgggcgcaacctccttcaacaagccgttttcatataggccagagaaatagacggctccatcccgaaggaaaaattcgttgtccaccggctctgtgttggtgattggttgcagcgtttcttcctgctcggctgtgatgctcaactcgatatcatcgtcgctgtaaatcaagcagagcccatgaggagcctttctatcgaaatgcagttcaatgtcatggtatttgaggatcaaaggtttcccgtcgcttctcatggtggaaacggcatcgggattcccgaagatttctatgacctcatcctgcgatattccgaatttcagcggtgaaatgtcccgaggattctgcaatatttgattgcgccaaatagtaaagtcctgtttcatggttttccgtccagtgccccaacggttttcatagcggcggaatcaaatttgcactgccgcagttcccgttcaatcagggcaaacacatcggggaagcactcgatctcgtcctgatactcatatttcgcatacagtttcccgtactccgagatccagacctctgccgggtagtaatagccgatgtgaccgatgggctgacacttctgaccggcagcctgttcgatttccgccagctcacagccggacatatcccggaaataggcttcttccaaatggtttttgatcccgttgaccaggtaagggaacaaagcaaactcaaagtccgccgcccagttcagctttttctgcgccaggtaccactcgcagcacaggccgaaatatttgcgataaaaccgctgggtggtcttcatcatcgggacgccatgatcggcgtaatacttctccgcaatggagatgtccacttttcgcccttcctgccatccggcgtactccatcagctgcttgaccttgcttttgagatcgccggaaatggggatgcgttctttcgtcacggtggtcacctccattatttctcaagtggataataccaatcctccgggccattgtaactgacctcaaatgcttctgtatcaacattcagttctgatttggctgttcgataagctacagcggcgacctgtttcagaatgggggtagcctcctcccagtagacgcatgatgcttcatcttccaactcagaatcttcgtcttcctgttcctcctcaaaattcaaagaaaaggattcattttgaatctctgcgtagaatggaagttcaaagtccgcaggattggtaatccggatctctccagtgggagcatacatctcggccatactcagattgccggcctgaagatatttctggtattgctctgcttcgttcttgagataccgttccgaggaggcccggctgtcaaagtggacggcgcttaccccagaggcaaagtccgttgtcaggcttatagtgaacaccgtgtaatccggatgctccgctttcagctttttgatggcggtattcacaagggacagcatttcttcctggtaaagggccgcgttaaaattcgtgtccatgattgtgttctcccatccttctgtcaaagttcattcggatacccgatcttatccaggcccgccttgatttcttcccattcattgcgcttagggttcaacgcaatgaccagttcttttgtcaccggaaccccatcagcaagctggcgcacagtctccaaaggcaggtctgctgggtaaaaccactttccatactccacataggtctgtggatcgccatcgatcaggggaagcaggtctttggatgcgtcctcgccgtccatgggattgcagtaccaggtgatgccgtcttccgtccagacgcagaaggtacttttcatctttttgacttcacggctgcccatgagcttttgcaacgcagggggcatcccatccgtcaggtcttctattcggggaagttttttctcccagtcgtagagttcggaatccacaccgttgattacacagccttccggcgcaaacatgacgatcatgctctggtcactgccatcagtggcaaagaatgcctctttgccttttcgccatgcggggttgtatgtatagtggcggatgaagctccattcctcctccaccatgatgatgtccagagctgccagccctttgcagaagtttttcaggcgctccgcattgggaaggccagataaatcttttgtggaaatcatgtggttatcctcctgtctttcctcaccacagccggtcgatcttggtatatatcttactgggttctctgtccgtaaaactggtcaatgagtcagtgagttctgtaagcggcatcacattcaaaatatccagtgcataataccagatcccggtgtcccagtcccggaaccgcccattgcagacagctcgaccataatcaccaggaatcaaatccagtgctaactcattgaggggctgtttttgccctgtcttatcgtaggtatatcgctccggcatcgcaccaatatgccaatcatagcggtaatgcacctggattccagactcctgctgaatcagttcaaaagggtgaagccgcattgtgccattaggcttccattccatcagcctgcgacagtcccgatcaatccgaaatccatcgggcctctgtacgatagatgcaaagtgagtaggcaggccaaaggaatagtaagagaagaagtctttcggcagccgcatcgctctgggatactggttccgttgtgcggcggcgtttccgccccgacagtctttataccattgcaggcggatctgctgaaccagaagtgtgggcagatatttttctctttttcgttcctcagctttcatgagtaatacagaaaatctcctggttcaaatcaaagtagatcaccatcagctcgtcggtgatctccgggttgaaggacagatccataatgaaaacttgctgatccatctcgtcatccaccaggctgccaaaccgcttgagccgcaaaaagtccaccatctcagtaaaggacagcttggatgggtcggttcccggaaaaagatcagccgcaatatccgggcctacatcgtcccggtggaactccatgaaaaatgtcacaacgctatggtagcggctgtcctcgtccgccagcgccgctttgatggcggctttggccttctccgccaatttctccgcctcatccagcatttctcccaccgcatccatggcggtaggatcagctgtcagttctttctctacatcgaagagaaagggcagtcccgattcatcgggaaaggtgaagatttcctcgccaggggtatatgtaaaatcaatgcgtttacaattcagtttcatagatacacctcctcattggttttccagatggggtaatgggattggtgaatagaccactgtatctccgtcattatccatcttgagaatgatagcaaattccgctgtattgctgtcctgtccctttgggagaggaaagatcattggggggcaacgcagggcagcatggttcgtggtattattccaatcttccatggcagcagataaaatgacatcaatgtgtgccaataccttctcaatggaacccgctgagatgttgtaaaaagtggggtttttatgatactgctctgtgatgaagtttttataggtttgcactggcataaagcaaaattcccaatcaaggggatacaacccaagccaatactcatacagtttcataggcgtatccttacccctcaatgttggtagctttgaggccctttttcaaggaaccgtagaccgttaccgcatggtcggtgaacatctcgtcgcagtcaaaccaggcggtgaagctgccgccggaggtgacggacaggctcgtcatgctgatccgccgggccagttcttcctctgtgatggggtctgtttccggatcgcgggggttttcctcatcctgggaaagccagttgttagccagctcggtcaggttctttgccgcaagctcccgcatggctttgtcccaggtttcacagtcggccagcagcttcttggcggcactgcgggcgcgggtccaggagggcttgctttcagcattgacctccagagaaaggagcacatcctttccgcaccactggatttcgccctcgaaggtatcatagtccttgtccagcttcagctcacccagcacctggtcctggatcaccaccggcttgtggtactcgtccagaacggcttgaagttccggacagtcctcgtgggccttgaccacctgggagatacaccagggccatgccaccagatcttttgcccattcctctttcatccggcggatcttcaggcggcagatctgctcgttttgaaagcgttcccagcccttttcgctgttacgctcctcatcggtgaccggccactccagccgctcctctttggtgctgaccttgccggtgtcacaaaataccacgcccagcgtcacaacggtcatttcccaaaagtttcctttccagttatatccgcctccaatgcagcgattgatcagagcgaccacttcctgctcctcgggctcgtacatctcataaaattcttcaaacatagatcattctccttatcccgccgtttgattgcggtattccttctccagttgggtgtaccaccgtttcagcatggtttccagactggtctttccgttgcgatctgtaaaaacaagaaacttctgcatcagtctggggaatagatatttgcccgcttttgtcagatcctgattgagatagaccatccgaaggatacggccctgccgatccagagggttctttttcagcagttccttttcaaagcagaagcgcagaaacaccacattctcgtcgtagaagtcctccaccacagccgcgccaatgctggtgtatgtgatgtcgtacaccaaccggctccagtcaaatttctcggcatagagtagtttcagcgcctttgaccagtgttcctccgggatcaccagcatcctgtgctgggcggtactggagtagccacggtagacgggttccgggtgtcccagcagttcgctcacactgtcggcatagacgaagcacaactcctcgtcgaacaggccgccgataaagttaccattgcagtacagcatatagtttttggacttggccggagagtaagagaggttgtattcctgggagtccaggattttatgtactttgttcaaaaaatctattgatgtcatcggtttgctccttattcctcaaactcgccctcgatcattccgttcaaataccggccagggtctgcgatgaagtcgtcccatttggccagagggtggaactcctcgtgttcgatatccagataccacagctttttgtccctggggctccacagcagcaggtagtcactgtaattgtccatggccgccatgagggagagcagcttttttcgtttccaggtcatctcctgcacatccatgaaggagtagagctccgcccacttcacccattcctgctccggaaactccagccgaagggggccggttttcagatactccaccagcttggcgggcagcttatagggcatgagctgccgggctttttcctgttcgttgtgccagtcctccggctccagggcttttaagtagtcggccagctcctgatttttgttctgcactgccacggtgtaaggccggtcgccgtatttgtcagcaatggtgatgtcggctccttgctcaatgagccagcgaaccatagggaaattgttggagcgggcggcctcggtgactggggtggaggcgtaagggaacatcatgtccggcttgtggtaattgatatccgcccctttttccagcagcagtttggcaagctcggcctgtccatcggacacagcggcccggaatgcctcgccgccaaacttgtccacggtgatcccggcttgctccagcaccgggatattctccgctcgctgtccccagcgcacttcctggaaggcccgctctttctgcttcgggctgagttttgcggcctgtccagcaaagagcgccaccaccaccggcccacaacagcgggcagcggtgagcagcaggggttgttcctctgccagaccgggatcagctccatgctccagcaggaagtggatcatgggcacatcgttccgaaaaaccgcgatctccagcggcatcagtttgatgtattcgctgagctggatgggaacatctaaatccagaccgccttggagcagcgcttccagcttgggagtgtcatggtcgcagatggcagcagccgtttctgggagagtctcccagcggccaatatatgcaatttggtacataagacacctactttcgttgttgtttcacttgatagggaacggtccggcccagcacccggcccttgccaacggcattggctccctcatagattaagaactccgcattgttttccagcggagcgtagtcaatggtatctggatagaggggttgggcattccccaaagccggttcatcaaatgcacactcgtctccgtccagaaagcatacccccagatattccgtggttcctttgacgacaaaatggggacaatattttccactcatcagactggggggagtctttcgcttgccgctccagaagatgacctccacatagagcaccgcccggttttcatctgtcccgatcatgccagtcgctccattcctgcttaatcgccaaaccgctcggcggcatcctggtaaacggtgatgcttttggccaccttctttttctggcttcggatgcggaagtagtcccgtagaatgcgcttcagttccgggttttccaccttgcggggcagcaggctgatgaacatttcgtcgtagctttcgtacagaacaccactccggttgtaactttgccaagtcaccgtaggctttcgaccttcagggtctttggccagatcaaaaagccaccgctcatccagctccacatagcgttcaaacataaaggtcgtgtcataggacccgtagcggtcatggccccaaaagatgaacgcagtcattccatcaggccccaggcgttcataggtccagtcctccggataacagcggtaatccagcatccccagagcattgaacaggtagatttctttgggagtgcccagcaggagcgaataggtttcatacacctgttccttgggctgggtgataattgctttcataaagactggaatcagccaactgccgccatagcgttcatatagttcatcggccagtgcttgtagtcgtgtatccgggtttcgaatcaaggaggcggtcagaatcaaagccggaatcttctccatttcctttggctttactttatagagccccagtccttgggaaatgtgccatgtagtgcatttgtcaccatcataaaagggggtgtgcttgagatggccgatccgttccgcattttccgccagaaaacggtacacctccaacatcttgggggaggctttgcccagcatcaaatgaaaacagaaattcatctgttccacctgtccctcttccagcggttttgtatccgcctcatccaacagcagggagagggttttcaggatgactggggcaatctgctccgatacacaatccgagcaggcatccgacataatatggctgcccatccatttgcccttgaccagcttggcccacagtggggcagcaggggcatactccagctgcgccaaagccttctgagcagccgttttgcacttacccttttctgtattcacaagttggaacagcagttcgccgtttgcttcatccttgcccagctccaaaatggcctgttctctctttacgcccttgggaggcagttgttctaaaatcatcagagtattcatagtgtctcgtcctccttcataagttgtccctgcacctctttgggcaggtcattccacaaaatatcgtatgtaaaatcccgaatctccgggtaacactcccgtgcggtcttttccgcaatatctctattcaggtagtgcatctcttggtggaaaaaccagttgagtttttccatcagccgatagagtcggatctgttcttcttgagtcatggctttgatcctcctacttcaatttcagcacaaatccccagatactcactacaatcagaagaacgcccagcaggaagaaaaccacacgccggtatcctctgctgtggcggtgggcatcccgcgtaccagtggggtcgcagagccagttccagttgcggaccgctccaatcaaaatcacggccccgatgaccactgaggcaatgtaccaatgctcctgtaaaaaagctgtgatctgctcgctgttcatttaggtttcctcctcgccttcgtcgtcgcgtatcacctcataccacgctccgtcttctccgcgcatctgcatggtaccatagggcaggttcaggagcgggataatgtctggatcgatgcggcagatgtcccggatatcatagaagccgcagtgcgactcgtagtattcatcaccttcgccgtacacatcgccctcatccccggagtagaaggcccaaccgctctcccagcccatatcctcgcgctcggggaacagccggtccataatctgcaccttgcacccatcctgggcgacgcggtcggaagcgtagcaaaacagagggccgtcccagtcgggaatgacagccggtttcccttccgctgcccgcgccacccgcttctcggggtcatctgcaaattccgcttccagatactgttgataccgctcatccagcaactgctccacacgctgacggcttttttcagtgtatggtagaagcaggtaggccgcatctttttccgcaatactgttccagacacggtctttggactcggccaagacgatattccggcagtcccggcggtaaatatagggattggagcggttgtcctgagcgtaccactgagcaaagccagagcctctccggtcaaagaactgagtggacaatttcccatccagcttgttcaggatgaacgcccgcaggtccggcccctttccggcccaaaccgcctccaccacctcccgatgccgggagaggaatgggttactcatttggcctcgtttcatagcccagcccaggaagaaggccatccgattgtaggcatccaattcatctactggcaggtgaagcgcccggattttcttgatctgctctgcggcgttgtccatctccgccgggtcgtaactgattttctcccggtctgtgaccacattgagccggtgcggattgatgacctccaagctctcgtccgggcagaggtccagcagggcgtccgagccgtgctccaacttgtattggatctcctcccgatagaggggaatcacctgatagaagttgacttcgtccccgtccggcaggcggcagaaaaaggagtccgtcccaaacacaccaggacagagtaggatctcaccacgcagctccgtgttctccgcgaaggggatgccatcctcaccctcatccagtgtagtcctggattccagccctacctccgggtcctccatggcgaagtgggcggtggccagcatcatccggatgggccagctccaccgctcctcccgacagtccgcctttgtcagcttccagtctcggggcagattgatgagcagctccgcccgttccagtttttcctcccaacgctcctccgggaaacccatcctatgccggctcaggccgacagtgaccagagtgtagtagtcatgctccggccggggcgggatgatggcgatctccagcgggtgatctgggtcgctgtcgtccgtgaggagctgggtatagacaccgaactgctggtcgatatgtactttcacatggccgaggatgtcatcatcggcagggggaatggtctcctgccggatgatcttctcccgctcgttccaatccagttccaaggaattttcctcctccagatactcctcgcagtctcgcaccagcttttgggcgtctatgtcatccggggccaaggacagccagcgttttgcgtattcataagcggtggctgtggagccgtatgccatcaggcaggagtagcccatccgagcattccagtagggatcgttctcaccctgggtgcggacggactccagcagatcaatggcgtgccggagaagatctccatccacttcagcgttctcgccaagagcaccgcggtcactcagcaccgccagattgctgtaggctcggcccaattttagcgtcagcagataatcccgctcccgttctgggatggcttcgatagcctcaatgcatcgggcaaactcgtccgcatcattccacttctcaatctgctccagcagctctgctctttctgcctgattcatcgtttcaccgccttttctgtttcatcctttgccttttttgaagtgtccgctgcctcgccaggtgttgactacgcaggtgaatatctgaccgcagtgcttgcacctaatcatgtgagccataatttcgtctgcccatccatcctcagtctttaccttctccagcggacaggtggattcctctgcaatcagttcaaattcgccttgtcctaccaactgctggatataggcaatacaggccaggtagtcctttggggcatcaaattttctccatatttgaatgtttcggcagtgctcgcacataatggatgcctcctcctgtaaacggttgttgtcagccctgtatatcagcgtcaacggggccttttttcagcgttccatccacagtgatcacatggccccagaacatatcgtcgtcctcgtaccaggcggtaaaacggccgccgggagatactgtaaactcggtgagcaggatgcgccgggcgaactcatcttcggtgatggggtctttctccgcttcccggtcggtctggtcattgtccgccagccactcgttggcctgagcggtgagcttctgggcagccatcgcccgcagggacttgtcccacacctcctgatctgccaccagtttcttcatcacattggtgacacgggtccaggacgctttcttttcaatctccacatccaacgagatccggacttcttttcccatccacttacaggtcccctcgaatatgctcatctcacgatccagcgtgagggttcccagcacttcgtcctccagaagaatgggctttgtgtattccgcccaaatctcctccagtgccggacagggtacgccttcctccagtacctcagtgacataccactgaggttcgtagagggcatcacctttccagccgcgggctttgatccggtagatctggcccttggtaaaccgcttggaatagtcgccggcatcccgttccttgtccgtcagcggccagctcaggtagcatcgaccggagatcacctgtccggtctgggcatccgccatggcgagggcatgggtatgcgccgcccagtaggtatccagaaaggttttgtctgcgctgacaccgtcctggatcagtaccagtttttcctcatcttccggggcgtacagggcaataaagtccttgaccgttctctttttcatggcgttctccttacgcaaatacctgctggtatttctctttcagttccttgggcgccgtcttgatgaccttgctgccgccgttttcagaggctgtgccccagatggcccagagcacatcacgccacaggtaggccagcgcccttttgtcattgccggattcttccggcaggtaatattccagatgccctttgatctccatcagagcatccaggctctcctcattggcgatcagggtgcggaactcctttgcgggcttcagattctgcatggactggacaccgtggaccaacaccggcagggactgagcagtaaacccgtacttcttaaaaaaggtgtgaataaacttttcttgcaaagaggagtgctcgtcatcacagcgatccaggtaatcgcacaccagccgccaccacttcggcccttccagtcccagggcaaacacggcaaaggtgccaggcatggcgcaggactcatcagagaggttgttgtaccactcgtcctcctgcatggccagccgagcataattctccatccggacatggagacggggataccgcaccgcacaggcaaaaagctgatggacacccttcttgggcaggccggggatgggcaggtagatcttctccggtccgcgaaactcgatggagtagctgcgggggaactccggctgctccaaaatctcaatcagatagctgagagcctcctcacaggccccctcgccgcagtccctggcggtaatgcggatggtggcgaaagcgtcgttggccgaggcggtgaaatgctccgtcttacgccgctggatgtcctttggcaatttgccgctgccagctgttttcagctgcttcaccatgtcgggacggagctgggaaaccaggccgaggatgtgttcggttttaagatactcaaagctctgtccatacaccgtgcagcagaccgccacatagcaggcaaagcgcagcagctcttcatccgcatcctcggggcgcaattccggcagtaccgtgcagggcggaaagacggtaaagccatcatcccgctctcccacaaggaagtagcgttcctgtacctgcttttctatgtacttctccaatgtatagtggatctcctgccagcccaccagccgccgcatggcgtcgcagagagagacagcatcctcacagggaaatcctttcaacggcagctcggtcagataccgctccagcagctgatcagggagaaatggcgtcccgttgtggtttcgcaccacggtcgggtaggcggagtgattttcacgggcggtgccgttcagcacatcctgaatgcagagatccgcctccgccagtacttctggtgaagtgtccggtttatgtatcagataataacggtcatttacaccatcgcgctttggtaagctcatgcttgatcacctctgtttagacaataaaaaatccccgcgacaccctgtcacttggacaggctgacgcagggcatgaaaaggccgcaagggagacgccacatccaccagcggatgtggtttcttcttcagccaaaatcaatttttcatatttgaacagaacagccgtggactgtcccagtttttcttccatagcaagacctcgggttacaaatttctaaatgggtatactttactattttattatatcacatcatctgttttctttggaagagagatttgctcctcagccaaatttgtgatgtggatttttccctttctctttcctgtcccggcatactccagcagttctctggcattgctggccggatgccgcacataggcgatgagaaaatcgctgcgctccaccatatatcggtttgcgcggacgatggcaagccgtttggggaccgtttccagatccggcggatagaacagagcgtcgaacgcctctggcagatccacctttctgttgactgggtaatatggggtcatcagcatcagcgtaatatccgggtgcgctcgcttggcctgcgacagtgcccagatcaccagacggtcgaagttgccataccgccccaccacaaattcagatacgccatattccgtgatatggcgctctatggtttcaagcagggttgggtacacccgatctggtgtctccctatgccctataaagaagcagcttcccatctgacagccctcatacacagtcgcagtcatattttattgattgtgattcataatagaactataaagccaacgcccattttaataattatatcactaattattcgttgtgtgaagcgaaagttgatgatttaagtgcgaacccgcgacgctcccttatattaaaataataagtagagattggagggagaggatcatggacgataaccgccgctatgaagcgtttgtgcggaaccgcatcacagagctgcgggaacagaagggcgtttctgagcatcggatgagcctggagcttggaaagagcggctcctacatcagaagcatcaccaatggaatttctatgccctctctccgggagctgttcaacatcatggaatactttgatttgacgccaactcttttctttgctcctatggacgatccggattccctgcgtgggatcataggcaagaagctgcttgccctgccggatgaagacttggagaaagtagctgtttttctggactggatcagaaaataaccgctcctactggcgtttgacatgaaaaatatgccgctcagtcagttcctgatagtttctgacatgggcggtttcttttttgcgctcttgggggaaagaacttccggctattgaaatttcaagctctttccactaaaatggatttcatcgtctgttatcaaccgttccgattacaaagcgaggtaggaaaaaatgaaccaaaaagaaatcaatgagctgcggcgccgttttcgcccggaaaaaagcgccatcagccgtgtttatggatgctatgtcaacagcagtaaagagatcgtttccgatctggacgaatccctgggcatgatgccgcaggaggagtccgagaagtatttgagccttttgaagaagggactgtccggttccctggggaaaaacctcattgatatcgtattctccactcagcaggtagtggacagtgaggaacaccgcctgctcaccacactgcgggattcccagcttaaggacaacgaggcccgccagaccttttaccacaaggtaattgacagtctggacatgggggacagcagttacctgttgctcctgacctgtgacagctacgatgttccccatcggggcaaggatgattccctgcaagcggatgcctcggatgaggtgttcacctacatcgtctgtgttgtgtgccccatcaaggagggcaaggtagagttgggatattttcccggtgacaatgaattccactgtgctgccgggcaaaccgtcgctcctcctgagctgggttttctcttcccggcattcgatgaccgggcagcaaatatctataacgctctcttttacagcaggaaggccaatgaaattcaccaggagttcattgacgcgatcttccatgtggaagcgccgatgtctgccgttgagcagaaggaagcattccagtcagctctgagcgatgcgtttgactgcagtctggaagtgatgcagactgttcatgaacagctgcgtgagaaaatcaaggagcacagggagagcaggagttcggaacctctggagatgagtgcctcagaaatagggcaaatccttcaaagctgcgggattgcggatgaacaggtggcagcattccaggaaaactgcggcgagcagtttggttcgggggttgtcctgaatccggcaaacctgatcgacagcagccgctttgagatcaagacacctgagatcaccatttctgctgatccagagtatagttacctggtggaaactcaaattatcaacgggcgcaagtacctcctaatccctactgaagatggcgtggaggtcaacggttttgctgtcagcattacagctgcacagaaagacgattaaatttcaaaagccggacacaacgcaaggcggtataacctttaaggccagatattgtttgttattttctgtcttaaataaaatccttagagtgggcgcttctggttggttcattatgaaccgggactcggttcacatgatatgtagaccctccccttggcgggagggtctgctttttacaggctatctcaccagacggtttcttgcttccagtgctgatgcgcagtcatggcctgtcaaatactgtgccgcatccagccattcctgttcgctgcatgcacctaaagggatcgcggcagtgagcctgtgcagccgttcactttgctggaacagccgaagatcagaaagaattccgcatcccatttgataagccaaataatccagtagatcgatctcaaccagcattggacacctccgtcataccacatgatacagattggaagtaagactcccattctcccgccagcgtgggtccttttgcagcagaccagccctgcagagatcatccagtgcccgcttgaccgtagagcgggaaagccccaactccagagcaatggttctgatggccggccagcagcgtccctcgctgtctgcccgatccttgaggtacatatagacgctcttggctctgtggcttagattggaattgtagatatttctaaagctgttcattctgtttccctccgtcaaggccgaaataccgttttgcgggaatccggtgcggcctgaattccctgagccataccgccagcggatgtgccgcctccctgcggctgctcactatccattacaatcgtcccatagtggcggcggatgatggactcctccaactcctgtttgtcagcataggcaacgaaccgctgggccttctccggtacttcatagggcatgccgaaccggatgccccagtcaaggaacagccgcagtttgaccttcattgggtggacgccggtcttggccacaataaagctgcccttgggcatggacttaagttcatccggggtcatgaggggacgctccatcatctggagggactggctgggatcgttttttccgcgggagatactgccgctcattaccgtccggctgcccaaagatttggacagttccaccgcggtctgactggccggggcgaagccgccgtaaaggttgacctggcagttgtccacgatgatctcagagccctcttttccatagtttttctgcagctgtcccgtaatgctctggacgataggcaccagcatgagtcctctggaccgggaggcggaaaacatcagttccagcgactgaatgggcgggcaggtgcccaactcgtccgcgaagaagaccacccggttcttgagccggccgccgttctcgtcggccacagtgaggatctcccgatacaggttttggaggatcaggctgaccataaaatacttggtctggtcctcctcgggcagtacgataaagatggcggatttctcattgcaaaacttctccgcgtcaatggcggtgtcaaagcagaggatctgctccatctccgagtcgaggaaggcgtttaggcgggacagtaccgttgagattacggaggccatggcctgctccgccgtgttgagggcggacccggcaaaccagcgggccttatgattaggcgggagcttttccagcaggagctggaactgattctttcccttcacccggctgggggccagcagttcctgcaccaacttgaacaccgacacgatgtggcgcttttcaatgggattgccgtccgcgtcctcggtgggcaggtactcggccaccagcaggaacatggcagtcagaaggccctcggcggaatcgtagaaaaaagcattctgcccatactgggcgctgtcgccgccgctggtgttgatgagggtcttggcgaggatcttggagtatttctctgccttggcctttgccgccaggtttttggggtcggctttatagatatccatgtacttgttgatcagatgaagcaggttgttgccgtccgagcgggtgggattacgcagatccaacacggcgatttggtatccgtagcagtccttggcaataccggcataattgcggaacaggtcgcccttggtatccgtgcagaggaaggacatcccgctggcgagggcatattcgatgttggggtacaaaaagaacgcggtctttccggcgccgctggcggcggtgaccatggcgtggatgtcatcggtgtccaccagagctgtaacatggtctttgggcccttcgcagccaaggacaaggccctgcttttccggcagatgctctcccttgcgccacagctctggttcaaaagggacatgggcataggtctgccgaatctcctgtttggtagcccagcgtgcggttccgtgctggccgtcgcccacagtcttggatttgattccgtcaagggtatagtaatgggagagaaacgcgaggccgccgatcacgagaaacatgatggcgcctaccacgataagtgttataacttgcgttggcacatgatcctccttttgatatctacgccttaatatcagaaggggatgttcagttttcgctttgtctgctataataaattggtatgaggtgattgctttgatttgcgcatgtgaccattgctactatctgtttgaggcgccggaactgccggagcaatgcccggactgtggaaagcaggcaacccggccagccaataagcaggagcgggcagaatatctcagcagacaaacaagcagccaggaagatgcggaggagtgggactgagccattcctccgctttgctgtttcaggcttaggccatcactggctcagtttccctctgggtcttttcctctttctgccgccgtttgatctcgtcggcctcgtacttgaccggcaccttggcacaggagatggccagctccagccatgcgctggccacctcttttttctctgcctgggtacggataccctggcgattgttcttggccaatacgctttggaattgcatggcgatctcatccgcccggttcttgaggatactccggttctggtgaggcaggatgtggctttctaaaaaccggactccctgctcaacggtcagcgcggtacccatctgtttgcactcccgcagcaccaccgagagggacagcgccgccatggtttccatgtgctccatcgcctggtcaaagcgtccccaatgaaggtcgttccggtactgcaggagcaggccggggatttgataagccgcccggtccggctgaacttccttgcacctggtcccgattcgctggcagacgaggtctgccgccacaaactgcggatgctcctcggcgggctgtgcctccagtccatgccgtgctttcagatcctcgtcccagtctttgtattcggattgcagcggggcaatttgagaatagccatgctcccgcagaacatccgagagccggccgacggcctcaattccggcagcgtcgtggtccaggcagaggatggttttccgcagatttggatttttctccagcatccacagcatggcatgttccgccgtaccacagagagccacatagctgtgctgctgccagccgtccgggtacagggtgagaaaggcaagcagatcgatgggggcctcgaatacatagagacggtcgctggtaccgacccagtggaaactgcaccggggatcactgccctctatgttgccccggtagcttttgccttgggtatagagcccccgcttgtgggcatgacgggcaacgccgcgttcatcgaatccgacgaacacggcgttgtgatacacctttgtctgatctatggacaattcccggctctcatagatcagtcccttctgtgcgaaagcgcttagtacctcccggctgatgtgcctctgctggagcagataagcatatacccgccgcatggcctggtttgagggaggcagggcaaattcctttggcggctctttttcttttttctccgccggtatatacacctccccctgttcaccattgagcagacgggtcactgcttcagggtaagtcaggccgtagaaattttggacaaaggagattgcatggccacccctttctgcagcatgatcataccactcattcccatgcacagtaatactgtgatctgaggtgaggcgtttgtcctggccggaggagatgagtttctctccctgccggcgcaggaactccaccaggtcaacggagttggcacggagtttttggtcctctgtgaagtggatatatggcacgctacatccctccttatcaaaaaagagaccgcagtatgcggcctctcaaatctgtgttaattcattcggttggttggcatctttcggagctcttggacttgatcccaacgcccatagaccacagcgatagtgtgactggaaaggtgcctgaaagggtaactgaaaaagagaaaaagatttcagaacttcttgttgaagctccagaggctattaatgggagtccgcaggttcatacctcatatgcctctcactgattccttcccttgagtttccggtggaacagaacaggtctgcacgggattggcttttgccttttcagcccttgaatgccttttggctgcgccaataaaatctgctgtttaaactgcactttctgtttcaaaagattacctcccttatagctgcatttccggctcatggtcatccgccttgtggccctgagcgatcttcttcgccttgatttttcgtaggagcttccgatccaccgcgacccgaacgccaccggagggcggtggttggttttgctcctggaaaatgttggccagatggtggaacagcgaaatgacggccgccacaggaggctggcccaagcggtcatccatgtgtttcaggaaatattgagcatattcattgccctgatccgctgccagctggaaccacttgatcgcactggatctatcttttgggacctccttcccaagcagatagagcttgccgagggcatactgggcgtattgattgccctgttccgctgcggcggtgagccagcggatggcggctttcacatcctttggcgcatcttccccctggagcagcagcttgcccagccggtactgcgcaaactgattaccccggcctgctgaccgcttcagcagacttagtgcttttacgctgtctttgggtgcatcttctcctgtgagatagaccagagccagggcgtattccgcatacccgttctcctgtttggccgcggcagtaagccagcggatggcggttattacatcctttgggataccgtcgtctcccttcagcagcagttttcccaggcggtactgggcaaactggttcccaagttccgcagcgtatgtgagccatttcagtgcggccgccgggtctctgggcagggctgcgtcaccggcaagatacagcttgccaagagcaaaggcggcgaagctgttttccttcgttgccgcaagtgtgaacagagccaccgccttttgaatgtctttttccacgccctgaccatcccgatagattttgccgagcgcgtattgagcacagtcctggccggcttccgccgcctttgtcagccgctccaatgcctgggctgtctgctccggtgtagaggatggatcattgaaaatcatccgggccagttggtactgcgcgtggggattgtccagtttggacgcctgttcaaaccactccctggctgccgtctcatctttaccagtccctacaccatggaggagcatccatccgatgcggtactgcaatttatcgtcatggctctgctgttccaattcgagaaatccggcgaaggcttgccggtaccactgttccgacgcttcggcgtccttctcacagccaatgccgtcccgatacatctttcctaactcgtaggcggcataggggaagtcctgctgtgcggaggctgtgtataactccagcgcccgcgcatcgtcctgttccacaccctgtccacggcgaaacaggccggcaagggaatattgcgcatacttgtaccctttgtctgcggaaagttggaaccaccgggcggcatcaccatagtcctgctcacagccgaggcccgcggcatacagtttgccgatccggtactccgcatagcgttttttcttctgcctctcaacagcatagaaagcggccagcgccttgctgtaccacacatgggcggcctgcatatcaatcttccggcccagcccgtccgcaagcatccggcccagatcgtgcatggccagcgcattgcctttttgcgcctcctgttggaacagggtaaacgcctgctcaagatcctggggctgatccttgccgccaaacaaacagcggcgggccaggcggtactcatcgctccagttcatctgcgctttggctggcgcagacaccgttttgtctgggacatcgtccggtggggactccgagaaatcattccagtcattatcaggctggggcgcctccggcagcggcgcttcttcctggtcctccacagggacacggtcttgctggtcatctggatggaaaacctgctggcgcgcccccagtgttaccgcttcctcaatgacgatgtttttgatccgcttgaatgccttctgctgggaaaggggaaggcgtggaggcaggtcatccttgtaggtacgcagcacatcttcccgcagctcataccacagggcataggctgcggcgacacatggctctttggccagctcgtccacaatctcatccactacagccttcagcggagccttgaggtagccgtactgcttccggcctccggtgtgccgcaggcgttccgccagatgctccatgagcttctccatgcggtggttgaccacggcgccgctccacatctgttcaattaactgctccagcatagagcgggcatcctcattcagcgtgtccctactctgggtctgctgctggtaaagctctgtcagctcctgccggaagatctcttttgccagtcccgacttgatttgggcgatgccctgcgtggtgagaaagcctttcgacggatcggcgctgtagcagaccatgtggatatggggatggtgtgcttcatcatggaatgcagcgtaccaccgaaaatcctcccaggggatcttcatcgcctccgccatttccatggcatactcggagagcagtgctttccattcttccgccttatcatagccgagacgggcagcgtcttcccgccgcagagagatgatgggcagccacacattaccggggtgggccgcgaccgcttccgctacctgcgccagtacgagctgatcttcctcaccggtaaacaatccatgggaaccgacgcgctgggcgcgggggcgggtggcgatgtacttcagatagttatccttcttggcgatctggttatagttgtcctccagagcgcgagtgatgaactccgatgcgttggtgcgtgtcggctcggccgcatagtcctcgtattcaaacatcccacggctgagcgggaagtcccgcaggatctgttccaccatctttttctgctttgaggtggccggccactcactgcgtcccggatcgatgcgctccacaccattccgtgtggccatatatttcacatagttttcaagatgagcggtggcggaggaggtaccgcccttgatgtaggggcacttgaaaatcaggcgcggcacagactgtcaccacctttgtgcatcactccacgccccgctggtagtcgatggcgtccttgaagctgatgcgcccattggtctgcttcacttcacggacggaccgggcgcggagtgtcttgagatcctcgtcactgatttccatgcccgccgccagtacattcatcatcatgttgacctccaccgccagtttgaagagcaggcgggcgatgcggttctcactgtcctggacggttccgcgcatggctgccaccagtgcgggcggcagatatgctgtggcttccttgccggaaacatagccggcatagaagcggattgccttttcaataaactcgttctggctctggcagttatccctttcacagagttctttgaccagttgctgtgtttcgggagcaatacgcagagcgaacttgattttttctctcgccatactttcctccaatcaaaaatccctgacctttgcatggccagggattcgttttctttaagaggcttctttacttcaaagctgaatgccgcccatactttgcttttgtgcctccttttctgtccatatccctgttataatgccggataaacgccgaagtgatgggccattccagccgtggtgacccccggtgtgatcccatcccctgaaaagtgacccccgcaaaaccgttccccggcccgcattgcggggcggtgtgagccgagcgggggacgctttgcgacccccgctctttatcctgcactgttttcgacccctcggttcaccctcgctaaaggcgaaagtgagaggccatcaacgcaggacggtcactgctcattttaggaacggcccgcacaaagcccccacaaatcgccgggagggacggcaggggtacggatgccacccagccccggaaaagggcacaccgggccgcacagggggcaatggcgggggaatgcgctccacttcacaaaaagagccgtgctgccgcacggcttctcatggagcatcggctattggtttgctcagttctgtgtgcaggccatagacacctgggccccctcgttctctgtctggctcttgatgatccagtccgtcaggttctggcattcactcaattccctggccagtgcgtacatttcacggcggccatcggcgctgttcagcttcactgctgtctcgaacaagccccagatattatccagggtttggaggccgctggcgtttatcggcaggtctttttcctccatcacatgattcaccttttcgggctcggctgcttgggtaactgcgatttcttcctgacggatcaagtccagccaccgctgtgtgtctggtattggaagtccccatgccgttccaacctgtgtcacagcctttcgatatggagttacatccacagctgttccatagagcataaggtatgcaatggcctcctttgcgagattttcctgcagtttacatacttgtttggctttcattcgttgaactcctttcctcggatttttggtttgtttcaggcgccggttggctgcccatgcaacaacacaatgccacacttccggagagaaatccattcatcattgccaataaaaagcggcttgagaagctgtgggaagtcgataaaatttaccgagcggcgtttcctacagccgaatctccagcccttcttccgcctgctcccgcagcagggcggtccttgtttcccccaagctctgtccattctgttggtgacagtaggcgtccatctggttccacaactggacctgttccgcggaagtcagcgggtagaaaaactcaaactcatgaccgtcagagcagacgagacatacggtcaatgcgctgtctatccgcccggtcttccagccaaaattggcgtacacattcagccagtcatcgttgaaggcagaggcaacattggtaccaaatactgcgtcaggatcgaagtttatggggatatagaagttcagtttcccatcgcactctgtgatctcatcggtgaaggataccgcatctaccggcagccttttggtacctgcagtgagttccggaggggcttcacgctccatatccaactgtgcgtagtaatcgttcagcgttttcccggtcctgccgaggtagtccgcttccatctgttttcgcaaaagagcccgttcttcttttcccaggggataggtgaaaagtttctgtaccactccatcctggcgatgtagagtaagggaaagggtggcgtcggcctcctgccgtgcggcgtcgtaattgcagagaatatccagccagccccccggctctaaacagtccgccgccgggccaagaacctcccgctgggcctcatcgctggtgaagtcaaactgaaaattcagtccatggcctgacagaatgatctcctccgagaaggtaagatcgccctcccgcagaggtcggattcctctggtttcaatcgaaccaaaggtctgcaattcaatattccggccgtacagataatctacaagtctgcgccattgttcgtttctctggaggttgcgagttcggttggcgtggtaggcggccgtagatacatccttgtttttgaaggtctgccaaccgtctgcgagattcagcgcggaacaccagccggcatccagatcaatctcaaacgcacctgatactttgccagtattttcgaggcgcaaggcggccaattcatcaaaccgctcccgcgtaatgggctgtgtcttataaaagtggtgggagaaaccgcccttcaccgcctcggcgtctccttgcagataacggcgcagccgtatggccacatccagaaattcctcgccattacccgttgagaagatactgtcatggccattctcccgaatatgaaaagccgcatagactttctggtcttccgctgcctgtgctgactccagttcttcctttgtgatagctgtttcaatctgtacccaccgttctaatggaacagtttcgttgtacagcgttatcaaataatcctgcagatgccgtttaacattactgccttgcgccttcagcgcctcctccagcgccgcccagcgccgctgatccagccacgcctcggtagatacagaatcggccattattcaacccccttcttctcgtcaaaagtatccggcgcggcgcttcgaggggaccgggcaggccgcgggcggggctgttcctccggctccgccatgctttcaatatactccctggtctgagaaggcacatattttttgtagagcttctccatgaacatatccagttccaactctaaagaggtaccgttctttcccgcatagaactggacggctttgagtttttcctgctcaaatgaaaccgtgactgtggcttttttcatcgtgatccctccattacagaaacagttccatggcatgttctgccctggaactgttggcaagtgtttcatcgtattgtgccagaagctgtgaattgacgccgtccagaaccagttccactccataggggccggggcggatggcggcaatcttggcatccagaagagccgagaattcttctttgccctgggcggtcagacggggaaggtccgctgcgggcacccagccaacatcttcggcggcatgaactaaatagacatcatgatccggcagtccaagtgtcaacagatcccgcagatggacggccggggcttccgccagcgcatggagctgctgctcctgcacaggctctggtggaaaatacactctggtttcactgccatccctgcagaaataatcgacctttctccactcgccgccatgggcaacctgcaactccccaagatggctgtatctccagttccgattattttccttgcaccactggactacatggtcgctgacgctgccggacttccagtcgaaggtgaagagagtttcacccttctgccggagcagttccgtccactgtacccggtctgtgaagcccatacttcgggcaacaaacgcctcacacatccggatcgcccagtcggacggctctgcctgatgttcatgtttctttctgaactcctccaactgccaaagcagatccaactgatcctgtttaatattgatgtttctttcctcctctttcgtgtcatccttggactgtttatccagcgatagattgtttccaaaggcttccgtcaagctctcgtagatgctctccgtatcccattcgccagcggcagtcagccggccagcgatctcccgcagggtcgtttcctgggcaagcatctcatcgccggagataagccagggccacatcttcgaggtttcctgctcaaagcgaatgtagtccacgatgtcctggtatgcgtcatcgcagtcaggctcatagcggtgggcgagatcgaagcccatggcctcaatctcctgattagtcagtcccaactcattgtgaagcgtcttgtagagttcctcacttccgtcatgctccgcaaggaaagctatgagcctgttctggattctgttggcgcctgccgttggaaaatggtttgccagggcatccaagctctcccgcaggctgccggcccggtggtcatattccaaccgtattcgcccattgtccagatcaatgaccgcccgctgttccgcagccccgccatgaccaaggtcatggctcagggcctccgcttcatctgcaaatacccgcctgagtggagtgccgcgttcagcggcagcgagagaaagagcctccgcgaagctgctgttctcattttccgcgatggcagcggcccgcgctaacagtggatacagccccacaagcccagctccatcctcgcctacaaaagcggtttgccgtccccgttgctctacttgatacagcactgccgtagtatccctcccatcgttttattaccgtgttctgtctgttttacatagagagatcctgttcctcacccatctccacatcccacatggtccggacctcattcaggtaatacccagccagttctttgtcctcgcaaaagaaggggacgatgccgcggaccccatagtgctcctcaccaaccgctgggttgtaccgcccaagcacatagtgaagggggactttttccattgtgaaaaaagttccccgcacagagcaagtcttgtccttttcatccacgctctctattactccaccgcgtagatcgaaatcgccggggcctccatatggctcggtagcgacaaacagcaccttgtctccagccgtcagctccttagctaacaggcagtcccgcatacgggaaatgatttcatcacgggaggtgaagctctcggcctcctggatttcatcgctctccagttcgagagcggacagagcctgctggtacgcggtatgaagccgttcatccggcacatttgggtcaaggcagtaaccgaaagcccctggagccaggcgggtgattcgttcctcatctgggatctgttgtaattcttcataggcggaaagcagattcaccagcttccctgattttgggagaaggtcagactgcacctcagatgcttcgatctgctcgtccacatattcatcatacagagcgaagccgaggcatccaatttcatcgttgcagatttccaatgtgttatgaaggatatcgtagaggctgctgtcatcgaaatactctgccatatagttcagaatgcctgatatgatctcctccttccgctctgcggaaagagagggggcgggctgctccggcgccaggtttttgcagtagtccagataatagcagacatcaaagcactcgtccgtcagggtgacatccgccgcctccggccgctgctccagcttctcaaggagcatggtatcgaagccgttcccgtcctctatcaccaatcccatttgctcataaagctcactgaaataatagcaccagctaccctcgttggtgttttccgctccctccctgatgatcttttccactgcctgctccagaatggaatcaaccaccgctcttgctccgggcaagtaggcaaagtgtttccccccatcataggcaaaaactccgtctttatgcccctctcccaaaacgaggacgccctggtagatccgtctaccgtgttcatcagcatagaacggctctgcagcccagcggccatcctggtgagggccattcaaaaagtcttggaattcctcgtccggcagcgtaaccagccgaactgcctcacactcaaagatgtggaagcgtccggccttggccggcaattgaagtttcagccgcaaaatatcatcctccagtcttcggtaaataatagcggggattggtacgctccccattgacccgcacttcaaaatgcagatgcggacctgtagacctcccagtggaaccggagagggaaatgatatccccagcctccactgtctggccaacctgggccagtagacgggaattgtggccatacaaggtggatagtccattgccgtggtcgattatcacatagtaaccatagctgctgttatattgggaaactgtgaccgtcccaggcagtgcggcccggataggggtgcctgtgggtactgccagatctatcccggtgtgtccccgtgtctcgccagtgaaggggtcgctgcgatacccgaactccgaggtgaccacggactcccagcctgctccgatgggagagcagaagccatccaccccaatgaacgggacatcagccccagggaaccagccgccgctttccccgctggggctgccataaaggatgagatgatagatactgtcagcgttggcctgatggtccgcggtgacctcgactccaatggcatggctgatccgctcataaatttcagccaggtcttcaataggaacggccaccatgtaggtttctgtggtctccacctcattgccttcttcgtcggtggtggtaaccgttcgggttcgctcctcataatccacgaaacagtccgcaaactcatggatgccatctgtatctggctgttctgcggcgaaatacagagcataaaaaatggccttgacgcgggtatcgtcaaggctttttccatcttcgcattgactattgatctccgcgatcacttcgtccagttggtcaaagctgttccgcatatcctcgatgtatctttggtactccggcgtggcgctggcggaaatggagccgccgtggaagcacagctccacggcggacacattgtgctgtgaggttcctgagaggatggcgcaaagcagaaccaccagaacgatcagcggggaaaggatagccacaatgccccagcccacctttttgcgggcttcctcattggaaagaattactatcgccgctttgacggccgctgcaacggtggcactcataggttcatacctttcatgggcgaatcctctggctgcgtactgttctgcagttcagaccagtacgcggccagctcctccatggtttccgtgtacccatcgcctttgggccgatgctccgcccacagctggtactgctccagatcaattccccggtccagcaggagcttggcggctccgaccgcctgattgctgacacaggcatagagcgcgtcgtagttgtccggctccaccggcatcccgtgttccagcagtctctctgccatccactcctgatgctggcccgtgagggtgcgcaggatgccggccacctcatcgcccggtcggacgcccttgtccaccagatccaccgcggtctggaagtccagcttttccgcaacccagcggagaagcttcgggggcacagaagcaatctgctccggcgtgcattgggcgatcaggtctttggcgatgttccggcagttatttgtataggcatagaggatcacctcaccgtggagggaggggagcggctccgagaggcggccttctgattccttcaccaatgtttgtacccgccaactgtctcccgtttccaccgcccgcttacaggcagtgagatatgcctccggggaaaacctctccaccgccgcaagaagtatcagggtcatatttcctcccacgacaccggggcgtcccgccacctcgatcagcaggtcatccgtctggtctgataccctgggataaaggtttttgaaggcgtcaaattctccgtcccgaatggccaacacggttttatcgtagtcgctgatgtgcagggggtaccgtcccacctcatccatataggcggtgatgctcccggtcatccgccgcaggagctgttccgtctgggacatggcctgttcctggcgttcctgctgttccaccagcgcctcgatgatggtgcgctgctccgtaggattcaggtggacgatcatgccctccggctccgcccgctcaccctgacggagatgtcgggcataggtttcgccgtccccgtggaacgccttggtgatggcggaggagatgaggaacatccggtccagatctgcgccggtttcgcccagcgtcttgccggtgatgaaacttttggtgacggggcggctgtcttcataccacttcaggtacacatctaaatagacgccctcgttgccgccgtagtcggtggtacagaagatgtcggcgtctttggggatctcccggccattttcccattcccggtccatgagaaaatactcgtccggaagatatcccatactttccagacggtgcttcagttcctcgaagacttcctgtgcgacgcgctgaccggcatactgcatcctccggggatctcccggaaacggctcccactgctccaattcaatttttttcattcgaatttcctttctcttttatagatctgctgttggcagttcacccttcatacagcaggaacagggcagatcctcatctgagaaagcgcccggaatcgccagctgattttcatccgcgcagataaaatcccgccaggcccagttccggcccaacccccgcactgatgtgaggtttggcatggctgcgtcttcaatcgccaaagcccgccgcagcaaatccgggtagcggtggtacaatgtccgaatttcccaccgcttcatgctggggcagaagaagcaggaagacttgcccggcaggggaaggccggcatcccggatcgcctggatgcagtcctttcggctccagccccactccatcaggggatattccttctggtattttttatcctgaaggtcatgaggaagggcgttgagcagacggcgctcctctccggcatcgtatccaatgaacttgacgaccttttctcctttctcccaggcatcaatgcagggctggtagtgcctgcagaacttttcctgcggggcaaccttgtgcttgagggagcattttttgtacccataagcaatggagggcagcgttcctgagcggaggcactcctgctccagcgtcagcctctggccgttcttctcggtgtaccacacccgcgtgatcgccggcatcccatggttctccagccagcggctcatggtgtccaggtaggcataggtatgcggctgctcggctccgggatcggcaaaaaggatcaggtcgactgggacatggtgccgccacagtcctaccagcattgccgtgctgtccgttccgcctccatacccaaccacattcatcgcccgcccgctgtgccgaacagcgcctccttataggctggagcgtgaacctccaacagataccgctcgttgccgcatttgaacaggcacacaccccgttgggggaatcggatgaggttgtactccgcctcctccagctggagcagatccatataaaaccgcttgtcaatggagccgcagttgaagatgaactggtggggcgggatagcgaacaggggcttggtcaactcccggatgccctcccggtcaaagtcctccagattctgcgaggccatgatgaggttggattccttcttgcggacccgcttgagagtgttgcggatatactcgatgatggtggtacccaccgacacattatccgacagccacacatacagctcgtccagcgccgctgtggtgttgccgatggtcagcaggcggtcggacatataggacaggatgttgaacagcatggcgccgcgcacattcttgctggcctgcagcagccccttgaccccgaagacgataaagcgggaggaggtcacattggtgtgcccgttgaagaactgagcctcggcgccctggcacatggagtggaggcccagcaggatctcctgcagcagttccgctgtgtagagctggtggcagttcccatcgtactctctgtactcctgctcaatgagtttatagaggtcggaaaggatgggatagtcctggggcttgaggccggcgaagttggtgctgtcgctgatgccccatttggcgtacagcttgcccaccatgatctcaatggcgtcgatgtggcggtctgagaaatccttgtaggcccggaaaaagtccttgagaaaggagatgtgctgggagagccgggtggatttgcggaatgcctccggcgcgtccctgtcctccgggccactgccgtcatcccagcacttgggctccagcggattgatgcggtacacgccgcccatcagatccatgaagcagccgcccaccgtctcacacatatccttttgttcgtgttccacatccagggaaatcacggatttgcccgcctcgaggaagttgagcaggagcagtttgagcagatagctcttaccctggccggagttgccgaggatcaggatgttggcggaggtcttatcgtcatcccgcttatcaaaatctacgaggatattggccccgtacttgtccttgccgatgtagaatccgtgaggatcggtcttgccagaataattgaagggatacaggttggccaccgagctggccggaaggacccgttcaaattgggcgccgaaggcgttgcggccggctggcataacagaaacaaagccctcctgctgacggagcataagccggtccacattgagcttggagcgaaccagttcggtgagcacatcggtctggagcagcttgagggtgtcgtagtccggggcggtcagctccaggaacaccgcacagtggaggagcggctcccggttgcggtgcatggaggagaccagggtaaccacatcctgcaggttggcctcggcagtgacagtctgctggagatcctcggtgctggagcgggacattcggtgcttgttggcggcgttgtggatgatccggcgctcctcactgggggtgacctgccgggtgtagatgcggatggtgaccccgtccatctcgcccagatgccgcaggatggcctgctcatcggtagaagtggggtactcccgcagcgcccatacacagcggcaggtgttgccgcacaggtagtggtccaccttgaagtcgatgaccgagggggcgaccatgtcgaggaaatccttgatatatggttcctccaccacaggccggggagagttctttgttctgtttttcggcaatgaaaaaacctcctgtccaggccggcaggagatcttttatcgcactgtttcttcctgatatggcccggaagttctcctgacggccatatcaattaaattgtggggcacgggtcagtcattcagaatgatccagcgttccccgtcgtaatcctcatatttttccgtggtggcattctgctcaaaatacacgcccagcatgcgcttgagatcctcgccgctggcgaggcttgccttgaagccctgatcctcgaggcttttctggatgcgggagaggtgggtgtgcagctccatccctgtttcctcacgcaaccggaccagtatgaagaactcacgggcggtcgccatctggatctgtagacggtccagtgatttagcgtccgcctccagcagccggctgatgaccggcaggtcctcctcggcagcccgctggcgatagtgcctcttgttgtcctcaaagctctccttggagttgagggccaacatctcgatctcagcctgccccttgaggacggtcatgagggcatagatgcgattgctcacagcctccgggggctggaccgagaggttggtgggcttgatggcaaagaaaatcagcctcccatgactggtctttaggccgctgtcggtgatctcgtcgatcccgatgagctgccgggtagtctgtttggccgttgcttctttttttctgctcattttctatcactcctatccgttgatggattacacagcccccaggcataggtctgctggcccaggaggaaatatcggattgcatagcgcaggaagtccaagatactggtatcctccagccgaatcgagaggaaggcataggccgcagtgattaccactgggggcaggaagccaagttgggccatggcaaacacagagatcagggcgcccacgccaatgatagcgatgtcccgcagttcccacagccacagtacggctttggatttcagattatcgggataaatgtacatgtttcacctcacatcgtcatgctcattccaaacccctgttcatcctgatcggggccgaattcctgatcttgtacttcgtctgggctttgttccatcaaccaagattggagttcctgtgccaccaaccccacaacgaagactcgtttggatacgccattatgcgcctccacatactgctcaacgcggtggaaaagagattcgggcatagcaatggccagcgtccgttctttcttgttgtcctgaaggaccgcactctggagcggttcctcgccatgttcccactgatccagtgcctgattcaaaaggctctgaaccagtgccttttgggtgaggggcgcatgagcatccaggtaggacttcagccgctgaaacatgtcatctgagatctgaacggccagggtgcgctgttcctgctttgctgtggctggctggtccagataggtagtgagtatcttagtgagatactcaccgtttgtcatttcaggacttttgccctccatcagccgcttgtgaagcgactcgggaatcaagccgcagaggtttttcatcggttccatgatcgcatctcctattcataatcattcaagctatctgtgctgtggtcgcccatgcgattccttgcaaaacatagtcgacgcaaggaatcgctacactgttgcccagtgctttatagcgggcggagtcggaagcaccctcgatatcagtccaaccatccggaaatccctgcaggcgctcgcattccagcggggtcagacggcggatcagaagaaccgaggcacctcttggagcggaggcgctgttatctggctcgtccatatccacgaccaaatctgttgcgtctttgtgctgacgagcgctctgagtgctgaccacctcgttgcttttgaacacatccacacgctggcggctgaacacggcatggtgatctaatcccgaggattgagttatcccgagattaggcgtggcctgttcgcaaatgtgctggtttttcaatactttttgtgtgttgttcataaataacctccagataagaaaaatataaaaacacctctataatgtagttggcggcgaaagtcgactaactgcattcagaggtgtttttatgtccgatgaaattgtgtttgatgttctatgcacaaaagtgctggatgcattacgggctctggggcttggtaagttcagcatacgaaactactactacgaagggatgtggccaatcataaaggtctaccgttccgagggggtgatattttatagtgctgcatttacaaatgaaattgtgaatcgttttcacttggatcatgaaaatggtttggtagccgaccggatctgggcaaaagtcagaaaggcatccattctcttcgaggagtatgttcaaaccggaaaaatagtctggaaacgtgttagacctgatccgaaaatttccttagctccgtactatcatgaactcctgcgtagattctgtcaacatgaagcgaatacgcgggccattggatttgagagcttacgggacgaggagaatgtctgccgcaaattctttgcatacctcgatgccagcggttgccatacttgccaagatattaatttagtaaatgtcaacgcttttctgctgttcatcgcatctcaacgaaaatcgagcatggacagagtgtgcaacacattgaaacatctgagcgcatacttggtgtccatacaaaactgctgcgatttcagcgccgcattgactactcgtcccgcgccccgaaagaaactgcggcctgccttttccgcaaaagaggttcacaccgtcgtggatgcagcggcaaaaaatccgtccttatcgctccgcgatactgcgatgtttgctgttgccgccagtttgggactgagagctggggacattgttcgcttaacgctctcggacattgactggattcatcatgaaatacgcttcgtacagaacaaaaccggagtggaactgcaccttcctctcgaagcatcggtaggaaacgccattgcgaactatattcttcacgagcggcccaaaacgcagtccccagctctctttgtgcgttcccgtattccttttgacttcatgacttcgactgctacgggagaccggctcagaaaatatatgaaactctcagatgttgagtatactccgggcgatggaaaaggctttcacagtttcagaaggtatgttgccagttccatgataaaccaagaagtaccgatcgatacagtgaaagaaatcttagggcatacgcagattggctccatgaaagcatatatgcggatcagccgggacaagctcgcaatgtgtgcactcggacttgacggtattgaggttgtccaggaggctttgttatgagatctgcattcaccggggcatttgcaccctatatttgcggcttgattgaaaagaaacaagccctcggctatgactaccacggaagtgcgtgcattcttcgaacttttgatgaattctgccgtgagcaatttccgaacgagacctgcttgactgcggagttagccatgaaatgggctgaacagttcaagaccgagaaaaatctgtccagattgaatagggtatctgtgattcgggagctcgctaaatacatgaatagtgtaggagaacaggcttatcttttaccacttcaactcacgaagaaaagcggacgccatatcccctacatttattcaaaggaagatttgcccaagttgttcaaggaaatagattctctgcagcccagccttagagcacccacaaagcatctggtggtatctgtaatatttcgcttgatctactgttgcggtctcagacccgtagaagccagacggctccgaagagaggatgtcaacctgtttgatgggacggtgaatatccttgaatcgaaaggacataaagacagaatcgttgtcttgtccgaagatatgcttgaactgtgcaggaattatgacctgcgcgtagagaagatataccctcaccgcaaatatttcttccagagtccaagtgtccgaggtgacggaatgtactcaatggagtggattattccgacattcagaaggttccttcagacggcaggcatatccggatacggtgagatccggcccagactttatgacctgcggcatacatttgcaacacatcggctgtaccagtgggtaaaggaaggaaaagatataaatgcctgccttgcgtatttgagcgagtatatgggccattcaaatctcgagagcacggcatattatattcatcttcttccaacgctttataccgacttgccagaactgcgtcttgatagttcccttgaaatggaggcagatttatgcgactgaaagacgagaaattctataaaacggtaagggacttccttgacatctacttgatcaagcatagaggctatagcttaaatactcagaaatcgtatcgagaggcaataaatcttcttctcctttattttaaaacggaactggggcttgaatatgccagtattgggttcgaggacatcacttactcaaatataaccggttttctcgaatggctctcaaaatccagaggatgttctccagcaacggtaaatctgcgtttgatggcaattcgttctttcacaaaatatgcagggatattagattccggcaaaatctatatgcaggtcgaagtcggcaatatttctgttcggaaaactccgggaaaagtcgtggagtttctgacggctcctgcattggaaactctttttgagcagcccaaccgcttcaagacgaatggataccgtgacttctgctttatgcggttgatgtacgacaccgcagcacgttgccaggaactggtggatgcaaaaattcatgatttgagcattcgaaagactcatgcaacaatctgccttactggaaagggaaataaactgcgaatagttccaatctccccctctgtggttgaattgctcaaaacttatctggataaagcacatccgaccgagcaaaggcagagtgatgactatcttttctttacaacgcatcatggtcgcaaaagcagaatgtccaccgatgccgttaatctctttatgaaaaaatatggtgaaatggcaaggcgggcttgtcctgaagtgccagaacgagtacatccacaccaacttaggcattcccgtgccatgcatctgtatcgtgccgggatgccgcttgtcctcctcgcggagttccttgggcatgccgacgtcaacacaacccggatctatgcatgggccgatactgagatgaagcggcaggcaattcaaaaggtatccaaggtcacagagggagatactattgaaccaatatgggcaaacgatgaggagttgataaagcgcctttatggtttggcttgattttaccacattttaatcgtgttcacaatgcggcgaccagatcatagctggtcgccgcaaatttattatccggaggttttaacatgaattacagcagcaaaaacactatctcgcaacaaaaagccgatggccaatcttactccctcgggataactcaatcctcgggattagatcacttatctggatatccagataagtgatcggtggcggtgagagtataggcgatgccctgttgatacccaatcccgttcccgccgttcataggctgccggtcaatggcatttccggtgatacagaatatcgtgtccggttctgcgaccagcgggacattgttcccacccgtaccgtaacgggctgacattgtgggcgccacagaatgtgggccggtgtagcgggcatcgatcccgtggttctcgaatacaagtggctggtggccatgctcctgtgcccgaagtgttccggcaacattttcgctgcaggcaatggcgcttccgccctggtcattaaggcacaggatggatggcatacagttcccgctggcggttcctttcaaggtaggcgagacttcctctccatagccaatactgcccgcagaagcaccagctccagcagaaaaagcagctgtaaaaatggcgggatacccttgtccgggcataccgccgcctccgcttagtgctgtgtgccgctcctcggaaaggaagcaatcaccgttgcctttggccgtgattccggccacaaaggtctgctgtttcatccctggctgggcggtcagcgccgcggctacatcatgaagatcccgcacctcgtcccgctgattggcggcaaaggcggtgagcacaccgtttcgtccagtggacataccacaattaacaccgagagtggctgccttttctcctgtcaggtctccgttgtatccgtcgaatccgatggggccagtcccgcctggaggatcagagcatcccggagctgaggcggcagttccttgcctctggcctccgctcgacgcagaatacccaggcaggcggttttgctcaaatagtatttgcggggcggatcgtcctgcaaaatctgcgacaaggaagattctcttgcgacgctgggcgacaccccagaattgagctaatgtatagcagaaaataatgtaaagtcacctcctgaagtgtagtaaagccagcaagaatgctcctgctggctttacattattctgtgaaattatttagttggaatatagagctgagtcaaccattgcatcaaattttcgtcatctgtccaagagggctgctggtcactaagctgctgcggatgcacttgctccaacagcttttgcttcattttaatgttcagccgggcatacacctcggtagttttaatgtcagaatgccctaacaggtcttttatatattgcaaatccacaccggcctctaaccaatgcatcgctcggctgtgtctgaatacatgaggatggacccgcactgggaacaaatcaggcttctccttttgtgcaagggaaacatatttctgtatgatgtagtagacaccgcctcgtgttagaggggccttgcttctgttgcaaaaaagcggggcatctatatcacattggcgatattgggattcctcagccagataatccttcaagatctttgcaggtacaggaagaactggtatatctcggaactttcttcccttacctttcagatgtacaacggcccattttttatcaaaacggatatcaccaaagcgaaggttagcgatttcagatgcacgagcagcagattcatagattaaggtcaagaaggcaaagtcacgccgtccctcacgcgttgtaaggttcggctgtccaaaaatagtttggatggcttcttccgaaagatgcgggacaaccctttgctcacatttcttcggaggaatttcccggatctgttggcatagcagtacaaagcctggatcttcatactgcaggaacttaaaaaacgcattgattgctgctcgccgttggttccttgtcgtaatagagttacctttctcctgttccagccaccgaaaaaaagcatcaattagctctctattgaaatcgctaacttccagcctatctcttcgaattttgcgttcccgttcacagaaatccagtagcaaggacattgcgtctcgataggattgaattgtttcttggcttagtcccctttcagatggtaaatactcaaagaaatatcttgataacgctttggcaaaaaaagtcggtccacgattagccatcctgcaatccctctctttccatggcaaggtcaaacggagcatacatgccgcccaaattctgttcacaaatatccatgatatgggggaaggattgtgcggtcaggcggagatagtactgggtggaactaatcgatgtatgcccaacataacgggaaagaatcagtagattgctgtatattgggagtccagcttcagcccatttttggatattatggcagcaaaatgtatgacggagatcatgcacgcgcggcccaaattgcttccctttatatggaatccccacatcccacaaaatgccgcgaaagaactttccaatggtggattttgtataaggggtcccgccctttgcataaaagaacggcgttgattcgacagtgtttttatgaacagcctgcgcatattttctacattcttccgtcaatgtggcagacattgggacaatcctctcgcggtcattctttccgtgccgtatgtgcaaaattccgtctttcaaatccacatcgttttttagtaacgccaacgcttcagaaattcgaaggccacagccatagagtacgcgaaataagagtggcatagtaagatgtcggttaggggataggttagtcggagaaagtgagtcaagtcgttcaaaaatgagatgtaactcatccgttgaaaaaatatagggtacgtgttgttctccgcatttgggaagggctggaagcaggtaggatggataaccttgtttgcacaggtattgggcaaacctctgcatttcactcactcggctatatcgggtggcgtccgcctcatttgggcgcttcttgcaccatgtcaatgcaatctctttcgtaattgtgtaactctgaatctcataatctttacaaaaattatcaaatagccgcagcagtttggcctgctggttatagtccagaccagatgcccttttttgtgccacataggattcgcatattggagcaaatggtcctgtaaagaagggcttcttactcatagaagcacctccaatgcacatcgtctcagcatttctgtattgaggctaacgtatacctgtgtgctttccggtgtggcatgacccagcgtttgcgcaatgtcagttaattctgctccattattcagcatggaggtagcgacactgtgtcggaagctgtgcatcccaatcggtttatccgtagagacatgaatacctgctttagaaacgagtttggaaaccaacctttgcatagaaccgctcatgacatcaaacggtgcaaggtgccggacaaatatacatggacagtctgtctctgggcggccatgctggaggtaatcaatgattgcccagcccacatcttcgagcaatggaagttctaagggtatcccggttttttgttgatgaattgaaattcgcttgtttttccagtcaatattctcgaatcgaagcaatcgcacgtcactgatgcgcagccccagccgggtaaccaacaacaggatcgcatagttccgcttccccaacggattggatcggtctacctgagtcagaatgcactctacctcatccggtgaaaaaacagtaggcaggcgatacttatgcgtccgtctgatacagggcaaagcattggcgtaactgatataatggtagcctttggccaatgcgtaatcaaacagcttgcctaagatgcgaattgttgccgcaaccgtaccgggagaaaatccagtcaaagattcaatataagtatttacatggtgcagctcaagcaggtggaaatgctcaatgccggactccagcagaaaatactcaaagcgaaatagcctgctccgccaagttctgatagaaccttcagccacttggttttggcgcaaactgtccaaaaagccttcaaatagctccttataggctggagaaaagcccttcaaggtgatacttgattgcttaaagaccatcccatactgtaaataatcgtccaacatatgaatagcccggctgacattctgagatatatccctatcgccaagatcggcaccataccgttcccagacaaatctccgctctaaatccacggtgaactcagttgtctgatgcgcttcgcagtatacaatcaactccttccatgtcgcgtctaaccttaaaatcgtgctttcactgtagccgagttcagctaagtgtgactttaacttgctgatcgttttcctgagccattcgctcaatgagcctgtgtgctctatcgtcattagcatattcctcctattagttgatatggcaatgccattgtttaaattatacggaattatgttaagtgtgacgatgattttttctgatttttcatcagttttaggaggtgactatacattattttcaactatacattaagcaaattatgttcagctgaacataattgagcatccatgactctccaagccaggctgaattgatttcccagaatgattgccccagcagattcccagcgcccggagtcaggtcgaggcactgaacaggagccgtctttaattcggacaatctcctcgaggacgatgcggaaatcttcgccgcccgctgaactgaatgatcctggtacattctcccagcacatatatcgaggtcgaacagtgtgagctgttctgccgcgccgctcatctgcatccctcatttcttttacaacgcggatctgctccataaacaggccggaacgctctccggcaagaccggctctggcccccgccacgctgagatcctgacaagggctgcctcctgtgataatgtctaccgggggaagttcggcaccattcagtttcgtgatgtccccgacatggagtatggaggggaacctctttcttgtcacttcgatggggaaggcttcgatctcgctggcccacaccggctcgatgccgttgcggaccgccgcgagtgggaaccctccgattccatcgaacaggctgcccagcgtgggcattatgccatacccatgctctgccctggagcttcgctttgctccatctcagcgggcagagcctcctgcttgatttccagctccccaatctgtcggatggggatgccgagccgttgggcctcctcaatctcacgggccatgccggaactgaccctgccgccgcagagccacagttcatcgcagacttccagcacccggtgtcccagccgcagtccaatttcccgttctgttggctcagcgtcatccaacatctgtgggtagagcaggtggacggcgatgggcgtatgcccctgatggatggcataccagcacgcctttttcgcaaacgcggtgtttgtctcaatatctcctgcatagggagaggcgatgtaaatcagtttttctctgctcatttcgccgcccccactgcctgtaccacggtgcgggtggtgttgaccgctgactgtgctgcatagacggcggacatgatgttggcgcgtgtcgaggtgtccagcccaaaggcgccgcagatgcggggcacttcaccggccgacagcatcaggccaaggcccagcagcgcatgatccttcagcaccagcagtcccgctgtaaggatggtggcctgcaggaaggtggtcagacacagaccgatgatctgcttgcaccactgcacaaaaccgtccatatagccgcggggcaccgagaacatatacagggaacccacagcaatctggatgagtaagactcctccgcgcttgaggttggagaaaaagcacttgatgacggcgtaccccatcatgatgataataaaaattaccatgatggggctggtgatgctgccaatcccgccgaatacgccggaggaggccgcggccccgatatccacgccctgcagggagttgatgatatcagtggaaagggcatcaaagctctcgccatacccggtaattccagaggtcaggctggcctgcagcgtgacggagagtttataaagttccaccggcaccagggtaaaacaccccacggccataaagcccttgacggcgctgatagccgcgtccttgatactggcccgtccggtctggtattcgattccgacctcgaacacggccaccaccagcccgacgacatacagcgtccaggccagataagaaaaaaagagaacaatggactgtacccagctcatctcgaagagctcgacgcccatgttccccatctcggcaaaaaagttgccaaagaaaccaacaagctggctgtagacccagtcgataaactgatccatcagcccgccaaggaaaaagtccaatataaacatctggtggtttcacccctttgcgtaagggggaccgtgccagcattggacgcatactcctgctcaaaggcacaggggccgtggctgggcacggcccctgcttgtattcgcttcctattttcttagcacatttgcgggctgtgttcctgcgcctcctcctgacgctggaacacctgcagatattcgtccaccgtacccgccagcagcctgtaatccgcctgagtaggctggtaaacataccagtctaccttcccataatcgtcccagaggtgtggtaagataccatccgagaagttgggattgctcacttttttctttcccagtaaatcgccaaagcgtaggatattcacatccaccgcgccctcggtccggttcaggatcgtcagcttgagggcattgtactggccggcaatgttcagagaaacaaactccagcctggcccgcaaatccgggtcaagctggatataggcggatctgcccgcataagacacaacgccgctggttttgcactgagtgaggattttcctcaactcctgtccaaatggattcaattttcttctttccctccctacatggttaattccgggacagtcggcgccggtggatgagctaactccagcgtactgccttccaaggccagaacgccatccagccggtgaataaggccctccatgtgtttctgccatccgtcccaatccttcggatcaaaccagccgccgggcagctcgccggctttgatctgccgctccgctctgatcctggcgtatttcaaagtgtccgcaaggtaatcccggagttcccggagagaagcccttgatgctgtaaacgaggtgacggaccggaacttgttgtcctcggccgcccactcctcatcatagtccaaactgccgggatcaccgtcaagatactttacaacgatctcagccagtgccatagggctggtatgcgcacaccccagctttacatcacagggggcattccatcggtctttctttaatcgttcaagcatttctcccaagtccagttgtccatctgccggtaaattgtaccggacacatctaaccgcatccagtccattgtcggactccagtgcggtgattccccaacagcccatagaaaccgtctcccatttccggcttacgcctcatcattcttgtcctacatttccagtttcggtccaatctgctcctgctcatccagcccaaatgcctcgcgcatttccgcatccgccagaatcccgaacgcttcctgacaatctgcgcagctcacgatccaggtctttccttcaaagtaccggagcatttccgccaatattctggtcttcgggtccgaggcagagagaagctgccccacctcctcccgcgaaagatatttgcgttctccgctccaggagccaatcacgccgacagtgtactcagggatttcctccggcagtattttacaatccagaaccggatctggatcaaaggtgaaaaacacatcaatgggagtatcttctaccacgcttaccccgatgccgtatggacctgcacctgctctgcacatcccggtagaccgctggtacagctcgttaaccaatgaaagcattttatttccggatggatttggaattggatattccattgcttccttcctcctgtattctcagaataattctttacattcccaggatcgtccagacataggtgggagccgtcagggtgaagataaggcaggcaaacaggatggccggcgcagtccattcgaactggccgtgctttctatagtcaaaatacgccatgcccaatttggcgaagaagaacacagccagaacaaggtcaatcacgggaaagaccacattattgacaaccgttttgatctgggcggatgcgtccgtccaagtgccttcaatggcaccagccacatccccggttcctgccgcaaatgcgggtaccgtaaacatgatggccagcatcattaccattacgaccgcacagagcatctttttcgttttcatcatcaaataccacctttctttgctgaaaaaagaaaggccgcaggggtgttcccgcggatggatgatctatcccgaacaggccgcgaggcactttcccacggcccgtttcttttctgattttgttactgtgaatgcttacatcgtgagcacaggtccactcagttcctgtgtttccaggaactgagcccggattatttcttcaaacgcttcctttgctaacctacagaagacagagtacataggcagaccgttctcagccgtgtattcatacggttcaggtaaccgcccgcattttgcaaaaaagttcttttccgcctccataagccgctcaatagaccactcacgtacttcgttccgatatgccaagacggtttgaacatggcgctcatctcttgcggagagaagcgtggggtaacgaagttcagcatactcttgggcggtcgtgtccatatagcgttcaaatgttctgcgtgtcggcagcccatattgaggcttcatttcccttgccactggcagccttctgttcttttctacaaatcccgcaaaggcttcttcgattttctccttggtccatactgccggaagcccttttttgcacattgtcaaccgcctctttacatcaagaaagaaatatctaaaaactgcgtttgagcagcctcgaccagtggggctacttcaatgacctctggattctgttggaacttcaaatctccccggaagcccagtttcaggttactgaatgtttcggcggccttcagcagttcgggcggcgatcctggaggcatctcctgcatccactgtacccattcacctttctgaaagcggggatttagccgaaggatcacatagtcctccggcacaaacttgggatagcggccgatgctgccgcccaccttatagtagggctttccctccatcatgaccgtggcccgcatgagcgtcagggtatcctccaaagaggcgcaaaaccagcactccctatcgcccatacgcctgattcggccatcccgcaggatgctgtccagattctttcggtgcgtgtagtggtagacctcgccaggctgctcatccagtcggatgtatcccatggcttcacctcccgcctatagatcaagcggagcgatatgccaatcgtcccatagattgccccggatattcagtgaatcggtgaggttgaccgagagcatccctgccggggtccagcagtcaatgacccaggtgttgactgtataggagccatccgggtaccagataggagtgaaatgggtacgccggttataggtgctatactcgttcttctggaactccagcctggaagacgaggaactgatggaaatgcgatccaatagccgccaaaaggattcatagttgaactctgggaagtaactgactgcattctgcagggcggtggtagccgacctctgggaactgttcactctggcggtgaccacctgattgaccccatagccggacttcatggtgctgtcgctggcggtgggattcttctcgtctggagtaatttccatagcagcggaaaggctggcactgtagcggtccagatcaaattcccaccagccgtggtcgcaccagtatccgtcctcatcatcgccatgccatacccaatactcctgccaccatgggtcccaaatggtccactgggccgaggttttctccggccggtctgggaccggggagggtgtgaaggagtcgttccggtcatctgctactggattgggcggcggattctcgtccagatctacgatcttacagtggatggtggcctgtgctgatcctgggccggatacatccacatcgatggtcatgtcctgcggctcgtccggtgtagtccagcgtacccaggccaattgggaatctccgtccgggtagtagacattgctgaccgtataggtcgtcccatcaatatggaactgtacagtgaccggatcatccgggtcactttggccaccgctgacctctaccgccgtgatgacctcggtattggttcggtattcatagtcataggtgctgatctccggctcctccggctgctcctcaaagcggacgataccaagcccaagggaggacttgatgtccgagttggacacattcttattggtggggccggaccatgcgggatagcctaaatctggggtttccagaaacatggacaggggaaggtttttggccgtcagcgatcccatccaatagcggagttgtcctccaaccacctcgtcataaagggcggcctctgtcgctgttgtggcaatcatgacaccttggaacttataataggcgatgggttccagcagaattttgtattcgccgctgatgagcgtgtcataatccataccagtttcttccgcaatgaacttgacaacatattctgaacaaaaatactttttgatggcctcgatgttattacgcccgtttgtacttatgatgcgaggcattggttgtacagggtttttatagctatacccgccttgtacgggagagagcccagtaccattattgtactggattttactgacctttccgaaatgatatattcctgcagatggtgttttgttggtcaaatcaaatggtgtagtaacaacggcatggtcacttgcccgcactacggttacacgcaccccttcgtttccggggttccaactgccatgactcgtcgcatcccccatactcccgccgccaccatcaatgttaccagacccgccagttccattcgcggcataaacttgtatgcaagtaaaggaaaatatcatcacaacggccagaaacaggttaaagagtcgtttcacttgatctcctttcccacaaaataaaaagcacagccaaagctgtgctttttgaagatgcgatattactttatcccattatgccaacctgagtattgatatctccatcactatcgatacttccaccttgatttgcgcctgcgttgggaacattatcgaaaccaggcaggccgccactggtgttggtggagggctgttcagggggaggcgtcacattgttgtgatcttgcggctcaggagtaccctcgaccggagtcccatccggcgtcttggtggggtccttcagttcatcctctgtatattccggtttgaccgggtccggctgaatggtctgctctgtgccggtaaaatcagcgccgtttccatcatcggtgttggtactggcatccggggtttccgggttaacggtcacattatctcccggcttctggtcatccccggattctgcgggaggcggggtactgctgtccgggtccaccactacatcgccctgctgggagctgctgggcgggagcaggtcatcggtgaccttgtctttgctgaagctgcttgcgatcacagcaaccaggattgcgcagaccacaagacatccggccacggtcagccacttcttggtattctccgtcatcgtttggattcctcctttttctgttgattatgcttcttgtcaaactgtctgtgtgacttcaggcggccaaggatagttcggctttaagatctgctgcctacattttcctataccgcccgtcctttgtcaacacgaaccctaccacaaacaggcagagaagtctattgggacaatagaaaactttttgaaaactgcgttaaaaccgaggggcatagcccgcgctgaccttgactgtcatccgcatgggcggcagaagctctcctccaaaagacactggaacctccaattcgatttcacagtccgccacaaaacggtcgccggcgctgtcgccggaagcgaacggtgcgttgcggatctccacatcaaggccccacacacggaactccatcccaccatcctctgtgtactgagtatggtagccgccccgataggtcagcccaaggatatcgtccaagcgtccatagatatcgccatagtccagtgattcctcaaaatctcccgccaacggctggtaggcgccggagtagccctcccggacgccatggtacacatcgtcatagttgtcgttgacggtggagatcacagcctcctgcaccgcatcccgaaccccctgggccacgatgagcagacggaaatattcgctgatgcagcacatcagcattaccagcaccagcacaatggcaataatcagggggaaggccacgccgcgccggtctttcaaaatctgcctgagtctgttcatttccagtacacctccgactttcctgtggcatctgcccgcagggtgatggggaaactgccaaagccggcaaagagaccgaggtcgatctcatgagtgagcgtgaccgtgacctcctcgttgagctggatgcggccggtatcgctccattcaatctccgggtccaggccggtctgctcccgcagggcctgttcccggcggtcagtttccggcccgatcctgccggcgatttccgcctcacgcaccagttcagtggcaaaggtatcgagctgctgtttggcaataaaggctgggaggacctgcactgccagcgcgatcaccagcatggcgcagagcaccaggacgcacacatcgatgtatccctctccgcgtcgggatctcaaaatccgtttcagcacatggttacctcctcgcctaaagtcagatccctttcctgacactgagcattatattcgctcaaaatactggagatagagctttccgatgaaagatcagttttatcacttgtcaggaattggtatagtgcttccacaggattttttggcttaaggattaaatccaagtcatcatcgtcgagttcataactgtcatggataagagcagaaagcaggctttcctttgccgcagtttcagctgaatggcgataaatttcatcggcagatagctgcttcaccctttgagcatattccttcatttcatcttccgcacgatcaatcaatcgatagatgctgcctgtatagtccattgggcacctcctctcttaaaacatcccgcccagggaatggataatctcgtagatgatgatggacagataagtcaccaggaagcacatgagcaggacaaaggagaatacacggatcttaggcgggattttcatggcctttgccttgaggcgctggagttccagctgcttcatatcgtggctgagcatctgaaagtagtggaccccgttgtcgcctcgcagcacgccgatgagtccgcggacaatgtccgaaagcagcggagagttgaaccgggcctcaaagcgggtcagcgccgcctcataggagccggaacgcatatccgcggtgaggacatccagttcagcggagaaaacaggaccggaattctgcttataatgctcaatcatgctcagcacatcccggctggcggccagttcttgggtgatggtggccacgaaccggggcagttccgcctcaatctcgtccctcttggcagagagtttttcctccgccctgcgaatctctttgaaataaaccgccaccgccagaagaacaactatcaacgccaacattgggaaaatcaacaggcacggaatcaccgtcagcagcactgcaccggtcttgatcatggcaaaggcggtgtactcctccggtgtcatgttcagcccagcagcggccagcgtatttttcagacggccccgcttatactcatccatatggatgtgtggggccagcttgatcgcccagcccatgagcagggcctccacactgcgggcctgcttcttctcctggcggcccaccgagagcatggcacgctgggtggccagacgggggagcctgagcagatcagccgtcaaaagaaacatacccagcgcaaggaatatgccaaataaaaacagaaggaaagtcatggttgttttgttcacctccacataaaaacagagccagtacacgacagatgtgtaccggccctgtttttcttcttatgctgtattacaaggcactctttctatagcattattgcatcacatctaactccgcaacaaatgacggatcaaagtcatcccgccagtttcgatagtcaggatacagtcccaaaccctttcggatgagctcccggttttccggggtgtcaatatagataccgtccgggatgccgtccatcccatagatgagccggaccccatcctgctccgctgcctttgctgcttcaaaatctccatcatagagcgccatgtcatcgatgcgttctacatggagggcctccggaatataggaaccatggttgatcgttgcggtaataaaatagcccttttcctggttactgatgaggatcacctccgatactcaatgggctgggtcagcttgatgaccgctgcggtgctgatgaacatcacagcggcaatggctgccaacagcgcctgccccagcggggtgtgcatcagaacatcgtaccagtcctgattgagccagtacaacagcgggatattgccgatgaccagcacctgcatggtgataaactccttgcggggctcaaacaccagattctccagctcaccgttgacgatccgcatatcggagagtttagccacgatgggagtcaggatggtcttgagcccccggtcgtgtcggcaggtcagcagagcggccacccactcccgaaacacggcgttgtcgatcttcgtccccatgtcctggagggcggcgtccacatcggggtccaccagcttgatccgggtgagaaactccacaaacacactccggacgggcgggttgagatagtcaatgttttcctccactgccgtctggatgtcctcattgcggagataagctgtggtgatgatagagagggcggtttccagttcagcggcaatgttctttttgtagtgatttgcggtcagacggataaaccagaacggcacgaacatcatgcccaccgccagcaccggcaccaggaagaggttgcccagcgtcagggcgaaggcggcccctaccagaaaaagaagcagggacagggcgcacaccatgggaaacttggcggcccggccagtcatccgcagaatggtctgtgtctcctcgatttcccggcgcagaaaggatttctttttgcgccgtgtactctcattaacctccgaccggatgcttttgggcttactggtgattctgcggaacaccccttcagtgaagtccataggggagatgtgtaaaaggacaaaacaacctgtgatcagccctatacaggcaatcaactggatcagattcatacagattcgcctccttccttgccggtttcaggtttggcaggcggcttggactgtgcgctcctggtcttcggagcgggcgttgcctgtcctgcctttgccggactggagcctgacttacccttagagggagcggactttttgcccacgagctgagtcagcacctcctgcggcataccattgtcgatgaaccgcttctgcaggctttccgagatggggttgaccgcctcgtggcggcccttaatacggtatttgccgtcctccaaccggttttcttcgattttgaagtgataaagggtgttgtaccggcgctccccagtgggcaggatctcacactccatgatctccatgattttacggctcttatcctccagctgcttggcgaacaccacgatggggaatgcctcggtgaccagatccatgagggtatcgtcggccatctcgtgcttacgcttgcagagggtgaccatacgccgccatgtagcctgggatgagttggaatgaatggtggtcaacacgccgtggccagtacgggcggcctcctgtgcggcatacgcctccgcagaccgcatctcgcccacacagatgatgtcggggtggtaccgcagggccatgtccagcagcatatcctgatcgatattctgcttggcgttctcgctctcacgggtgatggtgtggatgacgctgttgcacacccggccatctttctcccgcaccaggtccagctcacgggagccgttctcgatggtgaaaatacgcttgttgtccgggatggtggtcaggagccagcctgccaccgtagtcttgccggaaccggtggccccggcaacgcagacggaaacgccgtaacgcaggcaggcggccagaaagtccagcatggggcctgtggctgttccaccttttacgaagtcctctttctgcatattctgcgggttgacgatacggatggatgccgtgacgcccacatcctcgtccaccaaaggggtcttgaggaccgcgatgcggatgttcttgctgagatggcccaggacggcgggactggcattgtccagcaccataccgctgacatggagcatacggcggatcacattgacggcgtgttcagggctgtcgaaatgttcctccagcttgaccgtttcgccattggcgtacaacacctcgatatcccgccaagagttcacattaatctcctcaatgccggttccgaagatgtacttggtgagcaggccgaactcggccatctccgtgtagagggcgtccaccagctggtcgccggaatagcctttgaccgcgatgcgccggtcctgcacatatttggtgatgtaccgtttgatctgggccttggcgtcttcatcgccgccctcggtgatgagggcggaatacttgccggagatatattcctgcacatcctgcaggacggtgttgaaatcctgcccttcattctccggggtgaagaagagagaatgcgcccgatagccgcctgcagactctgtattcagggaccgcctggggagatcctccgccatgttcacgctatctgtgggatcagcttcaacccctgtcccatcatcagctggggcgtgacgcagcggctcatctgcgggctggggttctccaacgccggcttcatgctgattctgacccatattgccgcttaccgggcagtccgggccgaaatagagggggagttcttttttccgcccgtccggacctgtcgtgatatgtgttgcggcggctttctcagcggacgctttgggagcgaacagggactgacttcgcttctcgcctaacacccaaacacctccctggcaatcttctcgatctccttgcggaatacccggctgtccttcatggataggtccgccagcaggttgccggccagatactgtccctccagctccgccgaatggggcagcgtgaaggccactgtccccagcgcctgactcatgtgatccccggcctgctgggactttacattgctggcggtcttgtactgcttgtccgtatcccatttggcatcccgcaggaggggaagttggctggacaggtagctgatgctcttgaggtcggcgttggccagccgcaggacggaatccgcctccatgagcgccacagcggagaggatgtcgttggcgatgtaactgccgcagtcaatgaccacataaggagcgatctcccgcaggcagtcgatgagctcccgcgcctgcacctcgttgtaaggcgggtaggtgtactcattctctcccttgagcatccccagcatggtgaggtaacccaggcgtttgtgggtgaccaggttgttcttgaccagattctccgacacatgggcggcggccaacacgctcccgagggaacgctcgcactccagatctgccgccgggcagatacagggaagcattggggctgtcatgtcgcagagaaggaggatcacattccggcgcttgtcggccagatacttggccagccgcacggccacggtggtcttgccgctgccggggctgccccacaccgccagcaccccgccgctctgatcctcctgctcacaggcgtcctcctggccacttcctcgggaaaaaatacccgctttcttgaagttcagcatcaggccacctcctcggttttcgcgggcgcctccgtttctgcggtttcgctggagtcagcggcgggttcggactctgcgggattctcctgtggtttctcctcggggtccggctccgggggatacaattccagaatgatctcgtcttgagaggtcaggaacttgtcggcattctcccggtcgccccggtagaccagcgccagatggatggtcccctcggcctccagctcggccaacactttggcctgctcgggggacaccagcagggtgacagtatcgggcagttccttgtcatcctcctcgtccacaggctcaccggtgttggcgtcatagccggaggaggcggtaacactgataatctccacatactgcagctcagcggggacaacggtctggccctgctgcttgtagtccggggcgatcaccgacacaatgtcgccgctctgcagcttgccggagagcccctccgcaaaacttttgatggacacggagatggcctgctggctcccgtccaggctgtacaggtaggcgttttccgctgctggggcgtctgagagtttggaagggatgatatagtcgcccacagccagatccgcagtagcgtatttacccacgacgctctctttctgccgaaggacatcctctgggagattatagccgcccacctccacgatctgaaccatgctctcggtgatctcatcgccggcccggatgggctggactacccgcacgatctcagctttctggctgacgctctggttgaacagcggggtcagaccgaagcagatcagcagggagagcaggatgcagattacaccgaccacggtgcgatttttcaaaaaactcatactggcatttcctccttgatttcatgttgggtcggaaagtccgggcattacgcccggaccgatctggcccttctgctccgcttcaaccggggcagaagaatggcggccgccgtcaggggcagggtcacgccaacgatggtgagcacagtctttctcgttacatggaacttcttcatagcagtcaacctccaaaacagtatagtgcggcaaagccgatggataaaaatggtcccagcggtagcgccgcccgtgtcattgcgggtagcggatgatgaatgaatttttgaaataacatagcggtgcagaaatacagcaccgccagcagcagacccagcgccatcccccagatcccccgccaaaagcccagcacaaagccggccgcagcagtgagtttgatgtcgccgccgcccatgcactccggccggatcagggcggcaatcagcaggggcagagccgccagcactccaaaaaactgggcggggctgaaggagatcagccccgccgcggcggtcaaaagacagaggaaatccgggatagtacgcttgcggcagtccaccgcagaggcagcggccagtgccgtgagaaacaggaacgcctgcaccgggtatcagcccttgtagtcaaacatttcctctacgcgctcggtcacggtgggcaggacggtgtccccgaacagagtgtagaggccagccaggagcagggcgcccagcaccacggcaatcaggatcttgatggcggtgtcgatgtagccctcgccgcgagtgttgcagagaggggcggacaggtgggcacgggcgcaggtcatggcgcagtgggccttgcaggtcatcgtctttacggtgttggacatcttgttgaacatcttcttcatagagagttcctcctcaaaattttagattgttgattgttgtgtggtcagtgggtcacatacccatcttctgagcctgctgtgccgtggggtccggcgcggactggggagagcggttcatcccctgcgtcagtgcctgctggtaggcggtcacgacagccgattccagttcggcgcgtgcctcccgtgtgtacggaaaacagatgtccttgatttcacccttgctgttgatctggccgggcatggatacaaacagcccattgctgccctccatgagcttgacgccccggacggcaaaacagccgttgatgttcagcgatgcggtggcccggcagggaccgtcaaactggatagagtggatacggacatcatactgcatgggaaggacaggagtatcctgctgggaaacctctccctgggggttttcacttgtggtctgcgcttttgccatggtgggttcctccttttctgaatataaaaaataagtggcttttccgctcttgggtcacagggtcatggtcatgcctgattcctgctccggggctttcagttggacggggacgatagctgtgcggtccacatagtagaactcgctgccggaatcgtcgtagagttcgacaaggtctgagatggccagcggctgtccgtcgctgcccagggacctgcgacagaatgcctcccagatcccatccagactgttggtgctgacagtgccgtcaaacactgcctggtaacgggtaaggtcaggtccgccatattcaccactcatgcggtccagcccaatgaagcgcatggcggcgggagctgaggggccgagctgccagatacggcaggatttcagggctggcccgttgtctgctgccttctggtatccaccgctggagagacggtcatagatgccgtcctcccaccggacagccagccccttccttgccagccagtcctccaactcctcacggcggaacatggagtccgccaccactccttgttctgtcctgtagcccactggattcccatagtagagcagacatcgatttttcatttccacacttcgcatggcggcatatctcctttctgcggttaagtcatttccatccctcccatgcctgcgttctgcccttgaaactcctccagcttttctctggcccagccggggaggaattcctctttcagaacgccggtgaagtctgtgcggttccatctggtctgctctccatcgcccaggcaggtacagcggatagaccgaccgacagcgtgggggctgcatccaaagccgtcatgggccagccagagctggttctggggcgtccagcaggactccttgagggtgtctggactgagcaccaacacccggccctcatagtccagagattcataggagttgggttcgcagtgctccggcccaaatagttccagcttgccgtatgcctccctcacttgactgataaatgcgtccagatacgccagggcggtgtccacttcaaaataacggttatgggcatcatcgggtgggacataggctttcttttgccattcttggttttccgcgctgagctgctccttgtaaggccccagcctttctatcgtgttggccaggacgaaattggtccgcttgaagccccaccgtttcagcaccatttgggatgcttccggctttaatgcgctgcggccgtcgccatagacgcggatgacggcttcgatgtcccgcgcacaggatacattggcgtggaaacttgcatcccagagcgcagcttccccaagtctgtgggcctctgactgtgagccgggatagaggtagatatcctgttccatcttgcctcctttacggcaggcgccatttgcccgctggggggatcgtcagcgggctgatgcccagctcattgagcaggcagcaaagctccaccgaaagctcccgcagttcctccgttgaggggacgatgatgagcgctccatccgcggccagaaccgcgacttcttctcccacggggatagatgcctcggataacagtgcggcgggcagattgagttccataccgctgctggtgtatccggtacactcagcgtcgtcacaggttctggtcaccaggagtctgtttgcgtcacagtcgcagatgtactggttcgctggggtggtgatgggaacttcttcccccggctcatagcccattccgcgcatgaaaaatgcaggcagggtcagagacccgtctacaccgacccgaaccgttgtatggatcttactcatcgccgtgttcctcctgcccattgcatgcggtgcgttctccgtagatgagattccccaccatcagctgttcctccagctcgcccaggcagattccggcttcacccagcatctccagcaggtagggaggcacatcccgcaggtcatggtcatatccggcctcggcaatggtgacggtcttttcttcgtcatccacatagacacagagcttggccccggcagggatgccggcttcttcccgcaggtagtctggcagttccagcatgccgtcctccagatcatcgaatgggcagccatcctcgcagtcatcacaggtgccacagactctggccagatggacggtgagctccgtggccagccggtgcagggcatccatcgcctggatcagttccatggtggtcatttgctttttcagaacgaccaccgcgctgtccagcgtgtggatctcgaccttttctccgccctcaaagccactgatcttgaacgctccgccgggaatcaaaagagtaccattgtttatctgtttgttgaatttcatcttcttctccttattacattgaaattgtagaacgggctggattggatgctcccggccattcctgtccttgttgggcagccagcccgtcccggaaggctgtcagatcttctcctgtcggcgtatagcgtcttgcttcaagggcggccatcagcgcataggtctggccaacctcggacagcagtgcccgaagatcgtccgcaaccatatccgtccccatccggcggagctgcacggtaaaggtgattcggtaatgcggctggccggggatgctgtcgatccgcatatccattcccaagttggaatcgtgttgcgggcggatatagacctgacccactacgctggggcagacctgaaggcggccctgactcatttcctcaatcagctgagccgcctgctggagcttttccagttcagagagctgttcatccaattgcctcacccccgttccagtcaaacagcgtcatttgagagggaaccgcccggctccgctcccgcaggtcatagttggcgataagcagttccgggaactgagccccattgtcgtacctctgcttgatgttgttgatacgggtggtttccatgaggtagatgcctggcctgtcgtacagcccgcggacaaaggcgtcgtcgttgtaggagagcaggaatttgccctcgatccgcatcagggcgtcccgcaggcggatgtggtcggcttcggtgaaaccgtcttcaccaatgttctggtaatacccctcggtggcatggtagggcgggtcgagatagaaaaagctcactggccggtcatattgatggagcagtttttcaaagtccttgttctcaataaccaccttggcaagcctccggtgggcctgctcgatgagcgaaaagttgctacgcatatcgtggggctggctgccaaaactggtcagcccggaggcgtagctgtagcggatgagctgatagaaccatgccgcccgttggacatcgctggcggggctgtcccgcgccaaggcggagcggatgcggtcaaagtcctcccgtgcgttgagtacataccgcagagcctccatcagttcctccggtttgtcccgcacacagcggtacaggttgaccaacaggccgttgaagtcattgtagacctcaaagtcgttgccgggaggcttgtggaacagtacccagcccccgccgccgaacacctcaatgtaccgctcatagtagagggggaacagccggacgatcaactcccgcagggccttcttgcctccaatccaggacatgaaactgttcagggcgtatcacccccatccagcggcaggcgggtctgtgcggtatcctctcgctccagagtccgatccagtccccggatggcggccgcgattccgctgatccgcctggtcagatgggcgatggtggcccgcacctcctggtccgtggcggcatagaagtatccactcccgttgctggcgatggggacgccatcccgccgcagggcattgaccatgtgtcgaacctgaatccctttgatgccgaaggtcagttccaactcccggctggtggcggcgttgagagctcccatgtggtactgctccagatattccgccagccgttctttctccatgaatgcctcctttccgggcctgttttccgaaaaagggcataaaaagaaggggccgttttcccctttcggaaaacggcccctgtgtcatattctatatcctgtttttacttcatcgaatcacccccagctcccgcagcggacagatgcggtttttgtgacttggcaatagatcggctatattgacagagcgggactgtggtgctcaggctggctatactcataccggcgctctccaccgttccaggctacatagccgtggtcggtggtcgagaggccatattgacccatattggcctctgcgtaggcagccccgtcaaaggcgtctgttatcagtctgctgggcgggatcacgccgtttcggaccgcaagttcccgcccgtatgcggccaagtccatgccgcgggggaagaactcatagtgctggagattctgggcgagatccagagccaaatccagccggtggcagtcctccagctccagcaccgcctgccatttgtccaaccagtggggtgccccctgaccctgttccgcccaaacataaccgaagtcaatggcatggcgaaccagttcgctggctgagtcgtactggtcgagaatacccgtcagctggggcaggcagcagtccacctccagcgcgatgcactcgctgaggctctctgcctgtagcgagtccagccccagcaggagttcgtccggatggtttgagtcgatatactcgccggaatccgggaagccaacccaaatcccctccatattgctccggctggccagtttaactcgtatggcatagtcaccggcgaccggctggagggtgggatcttcctctacgaagggatctgccagtttgatgttccgcacatagtgaccgttacaaaaggctccattctgcgactggtggtaggcggcccccaaatgctccgcattcaggaatggacgggcggcatccgaggaacactctatgctctccatgacaaattttccaagcgcggcctcgtctcccgcgccatagaagaggtcgtaacagtccagttgggacgcaatccgcatcacatggccgatctcttggggcttctccaactccatcgccccttggaacaggatcttttctttctctgtcatattggaaaagcgccgctccagccagtcatgctccgattttgtaacatagaagccgtccagcttgtcaaagagggcggcgttttgatctgacatcgctcacatcatctccagtccttgtcctatttcctgttccggctgaaataccgggagaggctggccgtcctttctgcggatcagaccatactctgtgataacccccagccggtcatccagcatcttctggccgatctgggccgcctgcggggtctggaacagctcctctggtaaagcagaatacttctcacggaacatcatctccgcatagccccaggtctgcgctacctcgggacggagttcgtactggtcaatctcgcccatcaaccgtgtggcgtcctgcagactggggtggtcaaccacggataaaagcgccttatacttgaccatatccgattcgggccactcccgttctatttgagccaaccgcttggcaaattcgtcggcctgttcaatgccatcctcatcgtcgatagcgttgttgatagcatctcgcaggaaggggatcaggcaatccacacagcggaatgcacattcatccactgaggcggcatctactttttccaccgctctccatataccggcatccgctgcgggaagattcagcactgcggttttgtcgttatcatagcttgggtcattgaaaaatcccttacgcacctccagcatcaccggagcatcggagcgatggaagcaagccgtttcattggactggcacacatagatgtccttgatttctccacccagttccgcatagccgaagtcggtgaacacgccgccatgatcctcctgatgctgttctcccaacagttccagcagtctttcttgaaagccgctgccctcctctgtggtgtcaagcagagccatagcctcatttgagagcatttcatttgcgtataaaaacgcccccagttcttcatgattggaaactcggggcgcaaaacagcagatatcggtattgtaggtcaggttaatcaattggttcagcggaatgggagcgacgcggtgattctgcttgattttcaaaagagcatccatcccttttttctgctcctctgtcagtgaggccaatcgctgggcaaacaggtttaggtcgtatagattagcattccacccaatcatggcatgcgtgaggccattgtaatggatgcaggttagctcatttttgcagaagctaccgtctttgattctcgccttttggagtgcgtcgctgaactccgcaaaggatgctggcattttcattaccgtggccgtctcataagatttaggtccactgttgctgatctccacctcgaaaattgtcttatctaagagtaatccctccctgtgtagactcttgctcaggagcctcgggcggttccatgtctgagtgaacttcgtttacggtttccaatatggattccaagtctcttttccgagaaatattcgcaaaatccacggagcggcagtatacttcgccatcctttcccacagagcactgtgtctgctctttgcctcgcatctttttcgatttcactgccaggcatccgtcatcggcaattcgtgaggagaagcccttttcctttaaccgctccgacaataccgaaaaaaactgccgcgttctcccatcaagatccattttatacgcctctttctataaactcattccctgcatctcaatatcttctgcaggagcggaaggggcctcatagagtgtgcttcggccataagcgatgcggatgatatcctctgcggagtagtcggagccagcgccaaaaagatgcctgaactgcaggcggtctgacggagcaatgtaccatgtggaatactgagacttcagccctttcagggattcagccgatgttttgaaggtcagttccactccgtccttctgtaccgtgacattgaccgtctttgcgccacttttttggagggcatctgtaatcgcccgcatccgatagaccggtgcatcgctgtcctggctgagcatctgatactctgccagcaacgcatccttctttagaaactgcgccagaaattcctcctggttgtcccgcatgtactgttccgcagttgtttttatataatcctccggggatttgaggtaggagagcagggtgtcttctgtcaaggatgtataatactcactgtgaaactgtacatcgggtttctccccagaaaaaacgagggaagctgcctcccgccctgcctcggttcccttgtaataccggtatgaattgatgttcctctcactggtgagttccctgacagagaggcgacttcgctcattggaaatggccgcctcaacatagcggtcgacctcctgagcgatgcgcttcccaaacgccgtagaatcctggcattcttcttccgtcagtccggagacaaagttgggaagggggtcatccagaagatggagcgcctggtgttgccggtcgtacaggccgcagaactccaaacggtcgctccagctgatcctctctccataaaatgtttcgcatccaaagaggtaatcaatctctggcgttgcgggaactttcactactgagcccaaatgcttgcccttttgcagaactaaaactggcacagcggcattttccagccactcttgaaactcctgccggggaagtggggcctgcttttgctgcgacattacaaaatcctcccattttactgtttctgctcaaagtttgcacaacttgtctgtcccgagtatgactcttcatagtgtttggggtcagcaccaggcacatcccacccagccatgcttcctatctccatagcttgccgctggatgggggtgacgcccaggtcttcgttcaactcatccgccagttccacattcccttccttgtcgccggtatcccagtcggaggggtagtagccagtttcaccccgtttgatgcagataagctgtccggtggtccgcagggtggagaagcacagttccggcaacccctcggccaccttgggggcaaaccgttcctgttcggtttggatgctccaatcatcaggctgccacagatggacatacagctcgccgccgtccacctcgatggggcgctgctcgaagccttcgccccatccgtcagaggcttgtccacccaggtactcttttaagatggtaagctcttccggagtcagctctccggccacccggcactccgctacgccccagagctggcgattcctgacctcaacagtaaacaccgccgagcggaccttgtgatctacactgtcgtcctcaccgtaccagcgcatgaggccgctctcgttttcctctggtacccggttttttaccagagcggacagaatttgtccctcataatccatgagggtgtggccatcccactcctcaccgtcctctgacatatcccccactcgtcccgtccatagaagtccgctgtgagcggcatatacaatttgaatgtctgaggctctggcagatagaccgagaatcggtcttctcccagcaccagagccaaggtacatccattgtcccactttacatggaattgcccggcatcgtcgatataatccagtttcccggtactgccgggggaaatgggccggggattaccgcctatctctgtgagttggatgcgggaatccttggggaactgctgccgcaagaagtccagccactctctcggtacgctttgcatttacatctctcccattctaatcccaatatccggctgatttaattgttgatagagccgttccatcgcctccgccaccacgaggtccgaccggaagctttccagtttttcgtgatccgtaaagaattgctgttcaccgctctggaaatgaacaaagtccactgtggcgataccgtccttaataacgcccagccgtttctcactggtattgctgtcctggtagatttggattgcttcctccagagtcagatcttgcctgattatctcctgcggggtattggtgtccgccatgacaaaccaggcataggtgtggggaatgctgggatctgcggctttcctaagagcctgcttcccagtttcagtcagtccatagttgcaggtacggcgtgaattgtcctcaccggcaaaatccaacaggatatcgtctaccgcttttttgacctccggatcgtctgtcagcgtttcaaagcggaagccggttgtgctgcggaagggcagttcctcccggatggcctggagcaacgccttggaatccgtgaactcctgctgttcgccgctggcgaaggttacccgacctaccacagggtgttcctgtcggtacatctcctgctggcaaagatcatagcaatagaggtacccctgatactcgccgggaaagggagtacagcgtagacagaaacggtaattttctgtttccgcaatatagccataactcctgcggtcctctgtgatggagccgccatgctgccagcagtaggcgtccatggcccccagattcttcaggagtccagtctgacgcaggtcgtccacaaatcgctacagcacctctttgaactccggggtgttgaacctatcctcgttatgggccaccaggtgtgccagaactccttctcaccatggccgaaatccatgcggaggtggcctacagtacccagtgcctcgtccagcttttcttcggaatagaacagccccacctcatccagggaggcggggcgcagtacaaactcacgattatcctgggggtaggccagatcatgctcctcgcaaaactgctccagcgtcatttcttctcccagcagataaaatgtgccgttgacccggcgcgaagcagtaccttcatgctttaaagggattggagaaagtacggttcctgcatgatagtcagcggcatgatccaccagagtggttcgggtgctgggagatttatgtgtcccccgcaggtcatagcagtaccacccatcaggaatgatatcccgctgaatcagccagttggtgaacagcacaggttttccaagcaacgctgcgtgttgcatggagtctgtccagatgttaatgctcatttaatccctcccatattcacagtgttttcccactcgtgctggttccacagcgtatcttgtatctgcgtacagggattaatgcatctgcaacccatcttgtacttcagggaacggatcactgagctttcggagcaggccaaattcggtccttctcacaccatcctcccgcatataaaagttgcccattgcttcgaaatccgtaaagccatcgagggtagagatcagctcctcgtccgccccgatccgctccaacacctgcttgccatattcctccggatcgtccggtacacgctcgtagtcatccagttcgatggaaaacctcaaagcctcctggagcgttgccggctgttccacctcaaggacagagaggtatttcagcaatgcgccatcctcctgatccattatccggatattttccgccaactcgtccaattgctccagtctcagatccatcccctggagaggaagatattcccccagataaggccgcagggcctccacccgagtgagtttcgccatattgaggctgtccactcccagaagttgtctggcgctctccaattgctcaaaggtcgcaggcagagtgatctgcgctgtttcgctctgtacacgaacagggcaggggttttccatccatatccggaaaacgccgtccaatctctcgttctccaaaagttcaggtgtctttttctgcacataattgccgctggaatattctcctccatgcttttcccgatattcagcccccacacgggcataattgatatagggcttgaagcgatccggaaatggtgtgatccctttgttcacaaggtagatgcccaattctgaatcagacgacacattgttgacgagcatatactcatccagcctgtccgccacagtaagggccccctccaagttccagacacactccgcatccaatgccccggaaaagatggcggctttcgccggagaaagtgcctctgtgcgttccgccagtttttgtagtttttgaaactgctccgaatcttctacatccacatcgtacaggcatcggtaaaggaccggtacattgctgctcacatccaggatggcggtggctgtggtatcgaggctgattctgtccaggaaggcaaatgtctccccaatctcagcgggactggcgggcagttgcagacggacagtttcttctccttttccccggctcagagtcaacagaatcatcgttacattcctcccatctgaaattcctgttcccgctggtgctgctctgccggaccgccggccatcagctcccccaatgtcaatgtgccacagtaggccacatatcctttctccgtgaaggctcctgtttccttctccatacggagtttgccgtaacgctcataatcatagaactcctccagattggggtcatattcataatggccggagtcctggatcatgtatctgccatattcggcgggagtgcggactttgggtgcaaactcaaacagctccagatttttggccagttcgcgtatctcgccggcacactccggcttggccatctccatgaccgccgtcaactttttctgttccaaatcagacagtgcagcgatggccgtcgccatatcattcagcgcgaatagatcctcccgttgtccctccaggacctcctccacctcggatggaagcagactgtcctcataccagatgcgggcatcgtggatgttaacgcctgagcgtgcaattccacgctggagctgttgctcggagcagggcaggagcagccaagtgatttgatctgtattttccggctcctgccgggaggaaagccctaccgccagcagattcggctggtagtggtaacaggggaagtggcggccgtcatagagctgctccagtttcatcccgttatcatagaccacgccataaggggtaatccttccctcaagatgattgaggatcaggtccagagcgaacttgcggccatccagccgctcgagctcctcgattctgcagcccccaccctgcatcgtcatgtagtgctgccgcccaatggcgtccaggtcggagaagtctgtgatgaccgtggcctgctggcagcaaaaggtcagattgatgaaatcctttatatttgagacgcccaatttgcaggccattccctggaactgggcagcctcaccgtcatcaaaactgtccagccgtttggccagatagtccagctcatcaaaattgaccaatgagccaaccagcctgttcagtacggtatagaagctgtccagttcatccacccggcaatcctgccggagcgcgtcaccgatttccaatggctccagcagttcgatcatgcggtcatatttctcatcggggatagggaatggaaccgtaatctgcccatattccgggtgctgagcgctgctcagtaccgctttcagcacatagcccattctggtgcctccttactcgcatccatgaccgcctttccatatctggcaatcatggttgcgtaaataatattgtggaagtccagatcactcaccagttttgggtgtgccaaatcttctgcctccatgggtgacttcaggtcatacagccgtctggcggaataaaagatggggtaatcctgtatcgcaaatccatggggtttggatacgatgcggctgaaatcaatggaatcgtgtgaaagagcggggagcgccggttgccagagtcgctcctttgaggcgagaagatagagcgccgccagatagccaggaggcgcatcatcccataccctgtccgcaaagcggcttctgaggtggacggacactgtgtgcaggactgcctgatccggcccgctccagtgttccacagcctgaatcctcttgtgcaggccggcatgagggatgtgtccgaaatattccagaatcaaatccaggtactcaatcgcgccggacttcaaccgctccgcgatatacggacaggtgcggacttgacaggatcggcggcggtaatgcaggcagtaccggcaatccacatcctccggcttgtagcagaagcggctgaggatcatcatcccgccgccgcgcttctggaagccagggacgctcatcatcatatgctccagaccagctcgaggggtattctgagcgaaatatcttgtcatggcacactccttctttcaaaacaaaaaagcgggagctgcttatgctgcacagtgtgtgcagatgcggctcccgctttttctgatgtcacatatcaatttgtggctcctgtgcttgtccctgctccagtctgtccgccagatctgggacagtgtattcgatctttgtccttgcggtctgcatggctttgaggtgtccatcttccagctctgggccttcatccagcaggtagtctgtggcccggtagagttcagttagctcctccggtgagaaaagctgggtcttggagatcagcccggagcggacggcaaaatcctgcttggccccgcaaaaatcttcatcataataatgtccgtagctcacgccggttctgttatagtcccagatccaagtgacaaactgatagcccctgccattttccaactcccggccagccagcactgcgccgccaaaatccgccagcagatggaatttttcgctcagaccgctgatatgaagggtgggcgcagtttgaacctcctcaacataagtgtacacttcatctgcggtctgtgcgactctgtggtacaattcactggcctccggattattgcttccggcaggaaaaaggaacacatcgtttcctggagaaacaaagaggacaggctgaccatggaggaaaatctccagccgcctatcctctacattggatgattcaactccgccttctctcaggcgccgggaaagttcttcaaaaaattttttcaatggttaaacctcatttcttttttatctgttgggacgacaacaaaaaagcggagattctatcatcgaatctccgcttcaataactatattggtttttctccggggaagggaatcaggtgtccgtcctctttgtgttttcgtatggatagaacaatgactcacacatttggtctgtgtgagtcattgtttttggtggagataagcgggatcgaaccgctgacctcttgaatgccattcaagcgctctcccagctgagctatacccccatgttgccagaaacccttgattttgctggatttctgagctattcaattttttgactttactctccgttgcgggggagcacacccggttgcttgcgctcccagctgagctatacccccgaaccgcttgtcctatgcggctttcgcgctcggaacattgataagtataacaagatcatcgccaaatgtcaacacttatttttcgatttttcaaattttttcaatagggggttttcactcctcttcaggccgcaggacaccgtggaggacgaagcgtgcattctcaaattcatagctgcaggtggagagcgtcaccacccggtcctctgccctgggtgacaccttgctggaaaaggcggacttctcccccacctcctccagccaggccaggtacgcctgctcatcggagaaatccagcatccaggcactctccgccgtgtccgccacgtagccggaaaacagctccaccacataccgcccctccggtgtcaccagcagaaaaaccgggtgggcgtcatagtagacctgctcctgataattccccagggcggcaaacatagtgccgtttttcatccgatggccgtagatcaccgtgttgcggccagaaaaatccggccggcatgatgtgtccacaaaaaggcacccggcgctgttggccgtgccgtccaagagatggtccaggtaatagtcattgtccgtcccctggaccaccgggtaggagatgccggtgtccgggccgtagagccaggcagtcacatccggattcaccgccgccagggccgtgaagtccacctccggccaggccagctctgccggcgtctcctccgtctcctccgacgcagggggcagggacgcaaactgctccagtttgaaataggcgtctgctcccacccggtactcgtgcaggatccgcaggacctgatatccgctgaagcaggcaatgcccagaaacaggcagagaaagagcccgcagctccggcccttcataccccctcctcctttgcgcagtccttccagcgcaggctgcgaagctcgtccttctgctccggcgtgatccgatagctctccacagccttctgaatggtcttgttgtgggtccagcggtccaggcgacgctgccgcagatagggcagcgccgcgtcgtactgcttggccagggcggtggcaaaataccaagccgccatcatcttcacgtaatactcctcccgccggacaccggcagccagatccaagtcctccatctgaaacccctcatccagataaaagctcatcagcatccccaggccgaagcggacagtataggtgtgcgcatcctccacccagcggcggatctgtttccgcagctccggcggatgcttccggaatgccttcgggctcaacaggtcgcaggtggcccagttgtccacatagggcaggaatgtctccagcgccgccacggcaccgtcatagtccgggatcgccgagatcagcaagccgtggaggttattctcctcataatagcggtggggcagctcctggaggaagccccctgccaccggcgttccggcgatttcccgggccagcttccgcaaagccggcatccggacgccgatcaccgtctgcgggtctatggtgggtatcagcttgctctgaaaagcctgataggccgggtcccgcagggcaaagagcgcagtttggatgtccgtcatatccccgcctcccatcagcgcagctcgtccttcaaattgccgtccagatccagccactggacggcgtcctccgtcatccgcatacagccgtgccagctgttctccttggggatagaaacagagccggggttccaataccacaccccgtcctccagacgcctcatgggcacgtggaagtggccgtagaccacataccccgccccgtccagcagggtctgggagggccgctgatccacattgaaatggtggccgtgggtcaggaacagccgcctgccgcacagctcctccacctggaagtccgcctcgatgggaaagtgcagcaccatctggtccacctccgcatcacagttgccgtggacacagaggatccggtccttcacgctgttcagcatggcaaagaccgccttgggatcgtatccctccggcaggtcgttccgggggccatggtacagcaggtcccccagcagcaccaggcggtccgcccccgcttctccatcaggtccagcagcttccggcagtacagggcactgccgtgaatgtccgacgcgatccatacgttcatcgttcttctctcctgtcgtttcgtgtctcttccgggtatgcgggcccaatctccaactcctcataaccggtctcgctgtccggccggcgggtgaacacgcagctccggatttctgccagtacgatctcggccgtggtgttcaccgtgcaccccggcagcaggtggccgccgaaggcggagaggtcctcccggctgaagctggcgtgaaggtggcagccgtactccgatacggtgcccatcagggagacgatctccacatcctcctctccgctgcgcacccggacaccggtcgcgtcccgcagccgccagcgggagacgcagcccacaccggaaaccactgccccggcggcgatatgatgcgccttcacataggcctcgatctcctcgtacaaatcctgcccccggcggaggcggaaacaatgatacatgatgttccctccctgattgcccccgtctccggcggctttgcggctattgtaccacggaacggcgccgcgtacaacggatttccggcgacaatgtgcaggggcgcggcttccgccgcgcccctgcgcctcatttggaccgcttcagcacttccagcacgaaccgccacacccgctggacggaggcgatctccatccgctcccgcggggtgtggatgtccagcagattcgggccaatggacacacagtccagccccggcagcttgccgctcagaataccgcactccacgcccgcgtggatggcctcgatctttggcttccggccgtactgctcctgaaagacctccgtcatcaggtcccgcagggaggagtcctgccggtactcccaagcgggataatccccggagatggagacagtgcccccagctgcgccatcagggtccggaggcgacggtggagcatctccttctggctgcccagggagctgcggacgcagaaggtggccgtcagggccgtctgctccgcagccaggatgcccaggttcagcgaggtctgcaccagaccgtggatctccatgctcatggcctggacgccgttgggcaggcaggtgagcatgcagactgcccgctctgtggacgcccagtccataggcgtctcccgcacggtgcagggcgccgcctccacgcggaggcccgggtccgctgcggcatattcccgggagagatccgcggccaatgcctccgccgcctgccgggcgacggcatcgtcagataccaccacctgggcggacgcctccacggcgatggcgttgtcctttccgccgcccgccgccgtcaccaggcgcagctccgtccgttccgccatggcctggagcaatcggcccagcagcacacaggcattggcccggcccttgtggatctctgtgccggagtgccccccggcaagcccccggaccgtcacctccagcgccgcgccgccatagggcgcccgggtcacgggcagagtgcactgggccatgcttccgcctgcgcagctgacggtgaagatcccctcctcttcggagtccacgttgatgagcttccgcccccggagaggcgcggcgtccagggcctccgctcccagcattccgatctcctcgtccgtggtgaggaccacctccagccgggggtgggggatcgcctgatcgtccaggatcgccagggccatggccaccgcaatgccgtcatcgccgcccagggtggtgcccttcgcccggacgcagccgtcctccaccagcaggtccaggccctctccggccatgtccttggtgcagccgggctctttttcacacaccatatccaggtggccttgaagaatgacgggtgccgccgcctcatacccgggcgtggcctcctggatgataatgacgttccccgcctggtcctgatggcactccagcccccgctccctggcaaaggctgcgcaccagtcgctgaccgcctggcagttccgggagccgtgggggatggcacacagctcctcaaagaagcggaacaccccctggggctccaactgttccaacacgcgcataaacactcctttcccggcgggccattctcccggcgccgccgtctgtttccgccttgtagtatatcccattcccaggggcggcgcaagccgattgggaaaaacagaagaggcgccggccattttgccggtgcctcttccccgtgcgctgtctctcacgaaagctcagagaaccgcaggaccaccttgaacaagtctccgtccacagtcagctccagggtgcccttctggagctctgtcaggctccgggcgatggaaaggcccaggccgtttccctcgccgcctcgggcggcgtctccccggacgaaccgttccagcagttcctccgccgggatatctaacggcgcccgggaggtgtttttgaaggagatcaccgcctggccgtctcgctcctccagcgtcaggtacacccgggtgccccgctgggcgtacttacagatgttgttcatcaggttgtcgaacacccgccacagccgtcggccgtccgccaggatggtcaccgctgtctccggttgccgggttaccaggtccaggcccgcgtccttcagcttctgttcgtactcccctgccgcctgggtcagcagcacgccaggctggcagggggccagattcacctccagattccctgtggaggccttggacgcctccaccagatcctcgatcagccgcttcagccgctcggactggcgggtgaggacagccgcgtactccgggatcttctcactgttcgggggctcctttccgatgaggtccgcgtaattgatgatggaggtcaggggcgtcttgatgtcgtgggacacgttggtgatgagctccgttttcatccgctcgctgcgcatccgctggtccaccgccgccgccatgccctgggcgatgtggttcaggtcctcgccgtgggatttgaagtccagcaccatccggctggtgtccacctgatagctcaggtccccggcggccagagcccggccgcccagcagcagcttccggcacatgagggccaaagccagcaccgccaggagcagcaggagcttctcaaagatccacaggagcgccagcaggccccagctccaggcgaacatgctgaacaggatcccaaggccctccaggacacagaggcccaggaacaccagcacggtcttgcccaccagggggacgttgtgaagcagtcccgccagcccatgcgctgcgccccggaggccgctgcccagggcccgaaggaccgccccgccgccacggcggagcaagcggagggccacatagaccactgtattcctccaccagccacccagtttgagccgcagggccagggacatgcaccagccggtaaagacgcccgccagggcggcaggacccagtaccacagccagcaccacgccaatgcctccaaagttggcctccaccaccagttggatgcccaagaacagccccagtgccaccgccgccgtcagaaggtccagtgggatccgtgtcccccagccgggacggacgccgtccacgtaaggatggtgcccggcggcacacagcaggaagatgaagcagactgtcaccagcagcgccgcagcagcgatgatggcgtagatccagtagcggagggcgtaggccagttccgccagccggttggccagggcgtagtcgtcgtcataaacaaacacagaggacagcggcactgtaatccgcacggtataagcgttctcaacaacgccggcgctgggccgttccggatttgcccagtcataggaaaatctgaactgccacggactatcatattctgcaagccccgtgtaccagagctccctgccggtcttatcctgtaccatgacgtaagagatgttccgctccgcacagtagctgtctgctgcttccgtattcatctggtatacctgctcttcactgttccagatcaggaaattgagaagcgtctgcccgtctccccaggcgatattggaaaacagctcctgcttgaaagccgtctcgctggtgacatagacgtcggtgctgtacaaaaacaccgcgcccagcacaccgccggcggtaacggcggtcatcaccagcatcagcagaaaggctatgaccttggccgccgtactctccgtgagcctctttttccgtttcggtgccggaggctgcatgggctgctcctccatcaccgcctgggcgatctccttttcgatgttctgttcgatggccttcatgcccgcatccccttttccagtttgtacccctggccccagaccacctttaagtatctgggctccgccgggtcgatctcgatcttctcccgcaggtggcggatgtgaaccgccactgtgttctcactgccgaagggagcgtccttccataccttccggtagatctccctgggggagaacacctgccccgggtgctccagcagcagcttcagaatatcgtactccgtgggcgtcagagctaccggatccccatccacggcgacggtcttctcccggtcgtccatctggatagtgcccagggtcagcacctccggccggagtgcaccgctccccagctggaagtaccgccgcagctggctgcggacccgggcagccacctccaccgggttgaagggcttggtgatgtagtcgtctgcccccacgttgaggcccaggatcttatccgtgtcctcgctcttggcagtcagcaggatcaccggcacgttactcacctgccggagctttgccaaagcggtaatcccgtccatctccggcatcataatgtccagcagcaccagatggatgtccttccgctccagggcatccagagcctcctgacccgtgtgggcctccagcaaatggtagtccggattggccaggtagattttcagcgcgttgacgatgtcctgttcatcgtcgcagatcaggatgttatacatggggctccctccttggcttccatgataccggatggcggtttaataaaaaaccgggaaacttcttaagattttatgaagaccgctttcggtgccgccttccgccgggcggcacagccggacaaacgggaatctctgaacgcacggagcggcccccgcccatacgggcgggggccgcctgccccggatccgccccagcacgctgccgcagcggtctgtctggacctcgtcgaagccggattcctccatcttcccactgtaccagttctgccaccccctgctcccggccggaggggccggggatgcggacggtctcctggcagaagggatcagcagttcctcccggctgtcctgttcactccattttccgcagcgcaccgcgctgcttaagatactcctatggtaggggatttcgccggaaaaatcaaccccggaaaaaagccgcccggcgggagtttcccgccgggcggctttgaaggacgcaggcgcatacatttaggcgtccttcttcatcatgatgtccaggatggtcttgtcggtctccaccatgccgggggtgctgaccaggcccatgttgcggatggcctgctccggcgtcttgccgcagatgccgtccgtggactggagcaccacatcgctcatggccagttgggcacacatgatggcggcgttggtggcagtagccagcttcagggcgcagccgatcttgccgccgtcgcagatcataccggtgaggttgccgctcatgttgatgatggccttgccgatctgctcatcgctgccgcccatcagccacaccatggacgcggcggaggcggtggcggcagagacgccgcagccgcaggtggcagacagcttgccggtgaagatcttgatatacacgttcagggtgtgggaaaaggccagcgccttttccagctgctccttggaggagcccaggtgcttggccagctccaccacagggatgatggcagtgatgccgtggttgccgctgccggcgctgctcataacggcgtaggggcagccgctcatgcggccctcggcgctgctggccacccgcagcatggtgttggccgcgaagctgtcgcccagcaggtctgccttcttcagggccgtggcgatgccaacgcccagggtgtgctccaggccgaagtcggccagcttctcattcatatccatgccatccagcatgaaggccagctcctcctcgctgcactggtccaccagggcgcggatctccgccacagtcatgggagccagccgctcatggagctcatcctgtccaccggccgcatactccttcttcaccagcacgtcgttgttccgcacggtgaggacgatgttggagtgggtaccccggatctcgctgatgccgatgccggcggtggtgattacctctgcccgggcatacaactgtgtctcctcctgcttgatcatcaccaccacatggcgaccctccaccagccggatggcctcgtcgctgacggcgggggtgatgtcctccagcagctggaggctcttctccgggttgtgcaagcaggcgcccagagcggcggcgtacttcagccccacccgggagaagccggggatgcccacgctcatgccgttcttatagatgccggggttgacttccaccttgatggagacgatgtctccgccgatggcatggctggcgtcagcggtggccagggccacgcacaccggctccgtgcatcccagagcggggacgacctcctgccgcagcagggtcagcagttcttctttcgtaatcatgagggaagctcctttctgtatccaggcgaatctccaatggcccgcaacatattcaacctgataagataagcaaatctcgtgccaactgcttcccccgtgaatttcctgaaaaaacagcctctccccccttgtaaaggagagcgaattatgggaaaatggtcaaagtaaatggttaattgggaggtgagctgcgtggaaaaaaaggcaatctccatcattgcgctggaccccagagctgcccgctcctatggacgggatgtggagggcctgttcggagaggtggcggatgtctcggtgttttccgtcatggacgggagcgccatgggcatgctgccccatgcggatctgtttgccgcctccacggacgcctttgggtcgccggaagagctggcccgccacgtgcctatcgacagtcagaccatggcggtgcaggcctccttccgctggcaggagctgcggcggctgaaggaactgcccgccggcagccgggtgctgtttgtcaacatgacggagaccatggcccgggaggccatcgcccagctggagcagttcggcatcacccacgtccattggattcccttctatcccggggcagagctgccgggggatgtgcacatcgcagtgacaccggacgagatgcgctatgtgccggaggagatcgagaccaaaatcgacgtgggacagcgggcctgcacctccggcatgatgatcgagatcgccctgcggctggggctggagcatctgctggagacggagaagttccagacctatttccaatcgattgcaaccagcaattacagctttgaccagatgttcgcccgctccatccggctcgagagccaattccatattttaatggagacgctggaggacggcgtggtgggcgtcaacgaacggggcgaggtcttcgcctgcaaccgccatgcggaggaaatcacccgtaccagcgccgacttggtgatgggcaagccggcctctcaggtcttcccctatctccccttctcgaaatgtttacaggaacgggagcggctgcctgccaaaatcatccgcctcaacggcatcaacgtcagcgcggaggtggtgccggtgatgcggcagcgggcctgcatcggcgcgtttgccatcctgcagcggttcaacgacgtggaggcccggcagagccagctgcgcaaccagctgcttcacaagggctaccgcgccaagtacggctttgaggatgtgatcggggagtcggatgccatccagaaggccaaggaggtgctgcggcggatggctgtcagcgagagccccatcctgctgatcggcgagaccggcaccggcaaggagctgttcgcccacgcggtccaccgggcctcccggcggcggaacgggcccttcgtggccatcaacgtggcggccttcccggaaaacctgctggagagcgagctcttcggctatgaggagggggccttcaccggcgccaaaaagggcggccgcctgggcctgcttgagatctcccaccagggcacgctgtttctggacgaggtggagggcatgagtccggctcttcaggtcaagctgctccgggtcctgcaggaacgggagatcatgcgggtgggcggcacctccatcattcccatcgacgtgcggatcgtggccgccaccaacgagtctctggagcggaaggtggcggagggcaccttccgccgggatctgtattaccgtctcagcaccctgcccatcgtcatcccgcccctgtcggagcggggggacgatctgttcctgatcctggagcagttccaaaaggagctgggcggcagcttccgcctgacgcctcaggtgcggggctttctgaaatcctactcctggccgggcaacatccgggagctgcggaacgtagtggagtactttctctacaccggccacgatcccatcaccatggaggacctgccccccaccgtgttccacagagccccgcaggcgccgatccggcagttgccggagacgccgcagcagccttcttctgatgtgttccgctttgtgctggaacagctgtatcaggcctcagaggcccggcagcccatcggccgggagcggctgctgcagctggcgcgggatgcttttgtccccacttcccaacaggaaatccgaagcattctggcccagatggcagaccagggactggtccgggtcagccgggggaggggcggcagccagctgacgccggagggccggcagctatacgaaactggtcgaatttgatatttagatcaaccaataaaaccatttgaaagcaaatttgagaaaaccggtaccaaaatacggctccgggcgggtttggcttatctgccaaacccgcccggagatttttggttagaatttccgattgtctcctctgttttaaattctttttccgtttcctcggtaattcccgcttttttggcatatattttgctatataacaaagcatcagcgcacaagaacgccgcagaaaggatggatactaatgacctaccagtttgacgcggtggtggaccgctccgggaaccactccgccaagtatgacgagcggaagaagaaattcggcacagaggacgtgatccccctgtggatcgcggacatggacttcaagaccgcccagcccatcatcgacgccctgaaggcccgggccgaggagggcatctggggctataccgcccggccggacagctattttgaggccattcggggctggcagaagcgccgcaacggctgggatatcgaccagtccctcatgagcttcagcctgggcgtggtgcagaccctgtccgcctgcgtgaagctgttcaccccggagggtggcagcgtcctgattcagacgccggtgtactccgagttctatgatatgaccgaggcatggaaccgcaaggttctggagaatcagttcgtggagaaggacggcaagtggaccgttgactgggcagactttgaggagaaactgaagcaggcggacctgttcctgctgtgctccccccacaaccccctgggccatgtctggacggaagaggagctgcgccggatgatggaactgtgcctgaagcatcacgtgctggtggtctccgacgagatccactccgacctgatcttccacggcaaaaagcacatccccactgccaccctgtcccccgagatcgccgccaacgtcatcaccggcatctctggcaccaagaccttcaacctggccggcctgcaggccagcacagtggtgttccccaacgcgcacaaaaaggaggtctttgacaagttctggatgaacatggatatccaccggaacaacgccttctccctcaccgccatggaggcggccttcaaccagggcgatgagtggctggaccagctgcttccctatctctccgccaactttgactatgtggtggactactgtgaaaagcgcatccctaagatcaagacctatgcccccgacgccacctatctgatgtggctggactgccgggagctgggcatgggcaatgaggcgctccacgacttcatgatccggaaggccaagctgggcctcaacgacggctgctccttcggccggagcctcaatggcttcatgcgcctgaacgccgcctgcccccgcgccactttggaacaggccatgcgccagctggaggccgctgtcaacagcctgtaatccccagcaagagcgcgcagagaaataagggaaaaggagaaagaacatggcaaccattcaaaagaagagcttctggcagcagtacggaggcctgattctgattctgggcggcatcgccatcggcgccctgatcggcgctttcgcgccctctgtgggtaccaccatcaagcccatcggcgatatcttcctgaatctgctgttcaccattgtggttcctctggtgtttgtgtccatcgcctccgcagtgggcagcatggccaacatgaagcgcctgggccggatcctgggttccaccgtcggcaccttcatcttcaccggcctgatcgcagcggcctgcgtgctgacctgggtcaacctgttcagcccctccgcaggcgcctccatccagctgaccaccggcgaggtaggcgaggcccagagcgcaggcgagctgctggtcagttccctgactgtgtccgatttctccgacctgtgggataagtccaacatgctgcccctaatcattttcgccatcatcttcggcttctgcgtgtccgcctgcggcggcgacgagagccctatgggcaagctgctgaacaacctgaatgacatcatcatgaagttcgtgggcgtcatcatgttcatcgctcccatcggcttgggcgcctacttcgccaacctggttgccacctatggtccagagatcgtgggtgactacggccggtccatgctggtctactatcccctgtgcctgctctatgcggtgatcttcttcccgctatatgccttcctggccggcggcaagctgggcgtccggatgatgatccagaacatcttcccgcctgccatcacagcctttgccacccagtcctccgccgccaccattccggtcaacaaggaggcctgtgacaacatcggcgtgcccaaggacgtcagcgacctggtgctgcccatgggctgcaccatgcacatggacggctccgtcctcagttccatcgtgaagatcgccttcctgtacggcgtcttcggcaaggacttcgtcggcgcggagacctatgccatggccatcgttgtggccattctctccgcctttgtgctctccggcgctcccggcggcggcctggtgggcgagatgctgattgtcagcatgttcaacttccccgccgaggcattccccatcatcgccaccctgggcttcatcttcgaccctgccgccacctgcctgaactcctccggcgacaccatcgcctccatgatcgtcacccgtctggtggagggcaaggactggctcgtgaaggctgtggccgccaagaaggagaccgcctgattccatcgctttccagattgattttatcagctatccaattttagaaaaggagtttttcacatgaacgtcattgaaaccaagaatgcccccggcgccatcggcccctattcccagggctacgcctttggagatctggtcatcacctccggtcagatcccggtggaccccgccacgggcactaccccgaaggtatctccgcccaggcggagcagagctgcaaaaacgtgggcgccatcttggaggctgccggttccggctttgacaaagttgtcaagaccacctgcttcctggcggatatgggcgacttcgccgccttcaacgaggtgtacgccaggtatttcacctccaagcccgcccgcagctgcgtggccgtgcgggagctgcccaagggcgtgctctgcgagatcgaagccatcgcgctgaagtaacggaggtatcagatgaaagtcactgtcattggaagccacctgtgccccgacaccctgtacgccctgaaccgcctgtccgaggtcaaggcggagatcgagttcaagaatctctccgccagcctgccggacctgaaggcctatctggccctgcgggacagcgatccccactatgaggccgtcaagaaaaacggcggcatcggcatccccgcctttgtcctggaggacggcaccgtcacgctggatctcggggacgtgctgaaataaagcgatcacaaagcccggcgggggacctgaaaggtcccccgccgggtttctgctgttcttcaaacctccgtgacggctcctgtaccgccctcctccatctgccgcagggccgccagggtgcccagagtggtgcccagctgggtcagcaggatcgccgtgcgggacagctcctccgtggtcatgcattttgccatggccaccgctgtggcgtagactcctgtgctccaatcataggcatccatccctcggccccctccctggtgaacagtgtatgaggcggcgagggatttcttgacgggggcggcgtgtcatttctccagcaaagaggtcagatacgccgtctctgtccgcaggtccgcagagccggtgtaccaaagggtaagaacctgttttccctgccggagcacggcgaattgttcaggacttccgattccgtccgcctcctctgcccaccagaagccgtccagagccggggcctctattgggtccagcggcagttccggccggctgtccagaaagccggcccggttctccgtcagctctgccgtcaaggtctgggccaatccggctgtcagcatacggtaatacgcggtctggagaaaagcctgctccccgtcgggcagcaccgcagactggcgggcagcgtacatctccggcgcgatgggaagggatttttcctgcacctctgtccgcaaaggctccaggccgtccagggctgtcaggtccgccagaaccatctgcaccggcggacgttcccccgcttcataaaccgtccgcgccgcatggtcccaaccagagggattgccgtccagattctgaatgctgaccaccagattcagcacagatatgaccagtgcagcgccccacgccagctgtcccagccgcagctgacggcggtatagcttgggcctctccagcgggacgcccgccgtcagagtcttccacagccgccaggtgttccgggcatccagccagagctgcatccccaagatggtcagcagcgccgcagccaccagcggcgcggctacaaagcccagccagctggcgtttctcaggatgttctccagagaagcagccgaaagcgccaccgccaggatgaaatacgccgtcattaccagccagatcagcccgccccccactgtgcggaagatcatccgccgctttaagtatcggtatccctctccctggaccaccgggtccgtgtccagctccggggcattcgggtcatcgcaccgccagacccagaagggccccagctgccccaccagccgccagcccatgctccggtatgcctccacccgctccgggtccaaagcctctttccacctttggaggggctggagccggaagcggcactcccacggttcgtccagcaacaggtccacccggctgcccgtgaagcagacggggttctcccccttgcgggccaggtcctccagccaggtctccaccgccgccacgtcgtagatgctgatggggcagctcttccgataggagctctgcccatgtctgttttcagcgcccattctcctctccccctctccgctgatctactgaaatttcatcagaacggcggcgaagtagtcagtctgtatccgcaggtccttgtgcccggtataggaaaacatcagcacgcagtttccccgccgggccaccacgcactggcacggatcctcccgccgggagagctgctcatctccggcccaccagaagctgtccagtccggggacctttagccgttccggctccccgccgccgaaccacttctgccaggtcttgagctcttcctccacccgaagggccagccctttcgtccccatgcggtaatacgaggtgttgccggagatcagattcaacgggccgccggggccttccgtggactgccgggtccagtacatccggggtgccaacagcagggacttgcgctcagcggaaaaaccggtcagctcctccgagccctccagctcccgcagatccacatataccacctccgccagcggctcgccgtccccgtccatggccgaccgggtgaaatggggatctccgccatccgggagcagccaggatatcaggacgcccgcccaaatcaggaccattaccgcctgcgtgacccgtttctggagccgccaggatctggggcgttccagagggacgccggtgcccagcgaccgcagcagccggcgcatccggaaggcgtccagcagctcgacccccaccacggccgccgccatcagcagccagaacagtccctcgcccggcagggcatgctccagctgatccaccagaggcatgtccccggcgccccagaaccagggaaggacacagatccccaggcacaccagcaggatcgcgggcagccgcagcagatggcgccgcatttttcgctcaagatacccgtaccccatgctctggaccaccgggtccgtgtccagctccggggcggccgggtcgccgcagcgccagatgtggaaggtccccgccaaggtgcaaacatattcccaccccagctctctgtaggcatccgtcatctccggcagcggagacttctctttgcgcagcaggggctggagccggtagcggctgggagcgacggagcaatcctgacaaaagattccgtaaagcccccggaaccgcagcaggtgatagccctcccggtcccgttcctccagccaggactccacagcagccacgtcatagagctccacaggccggaactccctgtattcctgccgaccgctcatagatcgctccccccttctctttctgctgaacctccgccaggacggcggcgtaccgctccgccagatctatcgttggctccgtggtgcctgtggagatgctccacacctgatcccccagccggaccactaggaaccaatacccgtagtcgtcgcgagtggacacccaggtctcgtccagtccggggatctgccaggccatgatgggccagcctttctcctggtagtccgccaagatgccgtctaccagatcgtccgccagccaggggaaacggaggcggtagtagcggttctccgtctcccagtcgcccatgccctcaaaggtccaccactggtctgtggtaagccagttgtcccagtggatggcctggacctcctgcaatcccttttccgtgatatatgggaccggctcgtcaaaggtctccgccggttcaaagggccgcgatctggggtccgccatatcggcgcagagtgatgcgatgtaaattccccacagcagcatgatcgccagggacaatccgcaggccagccggtaaggccgcctgtggcacacgggtactcccgcccgcagaggccgcagataccgtcgtagagaccaccactgccggaacgccgccaatgcgagtgccagcagaaagccccaataggcggcctcccgccacagtggcttccactcctgcacactccatacgagaagggttctctctgtcagaagcgtctgtaccgccagcaccgccagaagcgccgtgaccgcggcccagaactgcgtcaccttttgctggcggcggaacagccggtcatatgcctgggcctctgtctccgggtccgtgtggagttccggcgcatcgggatcatcgcatcgccacaggtgcacggacttgccggaggtgtccacatactcccagcccatagaccggtaggccgccaggcgctctgggtccgggcagctctcctttactggggcaggttccagtcggtagcgaacagcctttggctcccccttctcaaagaccgccaggaagaaaataccgggaaccgagacggcaaaccacccccgggcggcctggtcctccatccgggcctgctgggcggctacgtcgtaaatgttcatgggcatcagcttcagcatggcgtttcccctctttttctattgaaactccgccaggacggcggcgaagttgtccaggtgatccatcaggtcccggtctgtccgcacccgctccatcagcaccgcccgccccatccggccgatgaagcatcggtttttatccgtgtcgatcaccaccgcttggtcaaagcggctgtccgccacctcccggacctctaccacggaccaggtgtccaagaaattcgctaagcgttcccgatacagggcctccgccaggaaggtgaaccgcacccggtcgaaaccggcccacagggacgctttaaaatcccagcggaactggctgacctcccggtgatccgtcagcagactccgtctctcccggtaaacagatgaatccaagggcagggcggcggcctccggggccactgcctccatggagacatagggcaagggctccggcgcgtcggacaagggcatctcctgctggctgccgaatacagatacggcaagtgcagccaccagtccgcaaatcccccaggagacgagattctgccgcctccgccgccgtaacgacgcatccaggtcctcagtatccggcgccatccccgcctccagctggcggcgcatccgctgaacgccccgcagcgcccgcagattgccgcagagccactccagggcacagaccaccgcaagcagccacacagcccacatccctttcaggaacacatccaccggctggccgctctcccagaggctgcgaaactgcaagatcgtccagacaacaatcagcaccatggagatcagcctatgtcgccggaacagccgcagctgcctctcccaggtcagacacagggcagagggatctgtaaacagctccggcgcctgtgggtccgcgcaggcatagacccgatagtcccccaggacgccggcaggctcccaccccatttcccggtaagtctcctcccgctcacattgggcgtcataggtctctgtccgcaggggctccagccgataccggagcttcctgggctccgccggctcaaactttccgctgccatagcgagaaaacgacaccggccgccagccctggacagctttttcctccagccaccgctccagaagggcggtatcccaataggcctccggcatgagaaaacgctttttcacggtgcctcctctctcatccccggcagcagccgctccgacgccagctcctcccgctcgccatcggccacgcagaggcgcaggcgggagagctcctgccggaacagggcccggccccggtccgtgatggcgtaggtccgcttccgcccctccaccgccgcctcccggatcaagccctcctcctgaaattttgccagaatcgtgtacagcgtccctggccccaggggtacccgaccggcggtggcgtcatccacataccggacaatctccgtgccgcaccgctcctgccgcagcaggctcaacagcacatagaacatgctctccgtcaggactttcagcggctccctggccatggtatcccccctaatatcgaaacacgatactttctgggttcactataatatcgttgcacgatattgtcaagctgtctgttcgcttccagctctggaatgttttgagggttgcagcccgccccctccctcctgtatgctcttgtacagcagcgacaaaccagaaaggacgaattttccccatgaaacgaaaacttctctgcggcctgctggccgcccttaccctgacctgcgccaccgtcaaggcggcccccagccgggtggtgcccgtccaggtggacggcaccgttctgagtcagggcgtcaactacctgcagagcggcgtgacctatgttcccctccggggactgctggatgccttcggcggctggagcgtctggtgggacagcagccgaaaggtggctgccgccgcctccggcagccagtccgtcaccgcaaacccgtcccgaaataccgtgacggtcaacggccgtacatacagcggcaaggtctttgtggagcgtggccggacctacatccccctgcggactctggccaccgccctgggcggcagcgtggcctgggatccccagctgggcggcgcggcggtgacctctcccggcgcggatcacaacgccatggacctttactggctcagccgcatcatcagcgccgagagtcggggcgagaacatgaccggccagatcgccgtgggcaatgtggtgctgaaccgggttgcggcgaaggagttccccaacaccattcccgccgtgatctttgaccgcaagcacgatgtccagttcacgcccgtctccaacggcacagtgtacctgccccccacggccaaatccgtggaggcggccaagcgggtcctgaacggcgagaacaccgccggcaaggctctttacttctacgcgcccgccctgtcccagggcacctggatcaacgccaaccgggcgtatctcaagaccatcggctgccaccggttctacctgtaattgacatttctcagccagggggctaaaatagggccatcaagaagcaaaggagcaagccacatgctgttttccgatcatccccggacccactaccgcaacgccccggcccatgaggtcatctgccagttgcggttcccgtctattctcaccatcaacagcgtggagcccgccgattttcaggaggccatccgcgcggagttcccccagtatgcccggcgccaggacgccgcgccgccccgcatcaccgggctgggcagccccaatcccaaggtggagcagcagcctccggtgaccaatcacaacttcgtctccgaggacaaccagtggaagctgaatctcaccaaggacttcatcgctctgtccaccctccactatcccgggtgggaggagtttgcccgccagctggacaagccgctggccgcctttatccggctgtacaagcccgcctatttccagcgggtgggcctgcggtatgtgaacatcttctcccgtgcccggctggggctggagggtgcccgctgggcggagctgttctctcctgcctacaccgctcccatgcaggaggcggagctcccggaggaccgctttctcaactgcgcctgtgatctgacgctgaagctggattccagctgtcaggccaaggtccacgcgggccccggtgtggtgaagcggaacgcccccggcgttccccaggacccggaggtgaagttcatttttgacatggatctgtccatgaccggaaacaccccctgcaccctggccgccggtgcgctggagacgctccacggccactccacccgcctgtttgaaggtgctgtcaccgacaggctccgggacgccatggaggccggataatctgcgaaaaagcccgggagacgtgtacggacgtctcccgggctttttgtacatgttgtcacttctggaacatgggggtggagagataccgctcgccgctgtccggcagcagggccacgatggtcttgccggcgttctccggctgccgggccagctgggccgctgcccacacggcggcgccggaggtgatgcccaccagaatgccctcagtccgggccagctcccggcccgtggcgtaggcatccgcatccgtgaccgtgaggacttcatccaggacgctgcggtccagattctccggcacaaagttggcgccgatgccctgaaggccgtgtgggcccgcatggccctccgtcagcaggggcgaggaagcgggctcaaaggccaccacgcgcacagcggggttctgtgccttcagataccggcccacgccgctgacagtgccgccggtgccgaccccggccacaaagatgtccaccttcccctccgtgtccgcccagatctcagggccggtggtcttctcgtgtgccgctggattggcggggttttcaaactgtcctgcgatgatgctgccgggaatggactgatgcagttcttccgccttggccacagcacccgccatgcccgccgctcccggcgtcaggataatctccgcgccgtaggcggcgatcagagcccggcgctccacgctcatggtgtccggcatggtgagaatcacacggtagccctttgccgcagctgcggcagccagaccgataccggtgttgccggaggtaggttcgatgatggtgccgccgggagccagacggccctccgtctccgcccgggcgatcatgttggcagccacccggtccttggcgctgcccgcgggattcatgcactccagcttggccaacagcacggccttcaggtcgtggttccgctcgtaattgcacagctccagcaagggcgtgcggccgatcagctcagtgacgctgtgataaataggcattggaaatccctccgttctgaatgaatagcctcatgatacacctgccgcaccgggtttgcaacggaccatttgccgaaaatccgcctttaattcatagcatttttataggatatggaagaaaaaaagcggaccgccgacaggcgggccgctttgagatggtatactcaggccaccacggggatttccacaatcccggcggcaccggcggcgatgctgtactcggggaacaccagcgtcacagagccgtcctcattcagatagaaggaggtggcgtcatccacagtggtgaagccgccctgctccggggtgaagaagaggccgctctcatccgccgcgatcttcgcatttacggcgtcattgcagatgccgacccagtcctcgcccagcacgtcggccagggtgatgtccttgtcgttggccaggtccaggttgtagcagtaccgctgctgcatggcagcgacccagccctcagcgaaatccaccacaaaggagaccgtagtgtcggtctggctcttgatctcgtagtcgataagcacgttcatctcccggtcggcccactcttcctcggtgccgccggtagccaggaatgcatccttgtaatcatcccagtccgcctgagcctgggccagatgggcgtccacccgctcctggatctccgcgttgaccttctcggccaggtcgccctcagactccacaccggggacggtcaccttgtagtcgatgccgttctccacggtctcatagtcccggatcgtcaggacctggaacagcccgcccagcaccggtacatccgcagccgcagccgcgaaggtcggggagacattcaggcccgccatcagcacagccagacaggcggccacgctgcccgcagtccgccggaccaccttataaccgcggctacggctgctggtcctgccctgccggatgcctgcgcggacccgggcgtccagctcctccggaatgggggtggactcatattcttctcgtgcacgcttgaattcgttcataattgatctccttccattgatatccgtaatttcttcaagccggtgtacagtctggttttcacggtgttcagattccagccggtgacggtgctgatctccttgagagacaggtcctcatagaaccgcagcttgatgatggtccccacctctggcggcagagcgtccacccgttgggctagcgtgccgtccgaaggcagagggtcctcatagctgccggcgtccagtgcctccggcgggatcagcgtcacccgctttcggctgcgaagcacgtccatgcacacgtgaaccagaatgtgataaaaccacgcacggagggcctccggctccttcagctccccctgtttctccagtgccctgcagacggcggtctgcaccgcgtccagagcctcttccctgtttttcaggtagctgtacgccagtcggtaaaaccgcgcctgatccgttacgagatagtcggtcagttgcttttccaggatatgtgacacgtttctcatggtcctttccgttcgttctgctgtatagacgcgccgggagcggaaaaagtttggagggagaacaattttctgaaaaattttctgcgcaaaaaagagaccggtctcccggtctcttttcatcggctggaatcaatcgtaacgcagggcgtcgatggggttcagcttggccgccttgttggcggggagatagccgaacaggatgcccaccgccacggagacgccgaaggccacaccgatgccgccagccgtgggcatagccacgaagccatcgttgccggtgcccagcaccagagcgatgacattggtcagcacgttggccatgaggatgcccagtaagatgccgatggcaccgccgatggcggaggtagtgccggcctcaatgatgaactggctacggatgtcccggcatttggcacccagggattttcggatgccgatctcccgggtccgctccgtgacggacaccagcatgatattcatgataccgatgccgcccaccagcaggctgatggccgcgatgaggatcaggatcatcatcagggtgttcagcatggagtccatggcgtccatcatctctgcggaggtcatgaccatgtagtagtccgaggactggtaggtcttgaacagccggttttcaatgatgcccttggcagcagacgccgtatcccggtccgtactggtcatcagatacatgtccccatatccgccccccagccgctgggcattggcataggggatgtagatcacatcatcgacgctgccctcggtgctgtcgccgctctccgccagtacgcccactaccatgtagggcacgccgctgacggaaatcgtctgacccagcggatccgtccggaaagcgttttccgccagataggaaccgatgacacacacattctgatggcgctccacgtcaatgtagcggaggaagcggccattctccaggctggagccctgcatggtcttctgggtgtcggcgcggtaaaatgcctcgctgacgccgtaaatgctggtgcggtcgaagtcctccgttccctgccgcaccttggctgtggcggacacatagggcgtgacgccggagaggtactgggggtacttctccacaagcgcgtacatatcttccgtgctcacgtcccgggtgccgccctcgccgcggccgtagaccatcacctggatcaggttggagcccagctgctcgaactgggcgttcatgtaattctgcatgccgttgcccaggctggtgatgatgatgaccgccgccacgccgatgatgatgcccagcatggtcagcagcgcccgcatcttgctgagcagcagggatttgatggccagcttgaaggattgggtgaaattcatgccggctccccctctcccgcgtcctcctggggctggaccacggcctggggatcactggcgtccccgtcgtagatgatccggccgtcctgcagacggacgatgcgcttggccttaacagcgatggagttgtcgtgagtgatgaggaccacggtgtccccctcctggtttagcttctgcaggaaccgcagcacctcccgacccgtgcgggagtccagggcgcccgtaggctcgtcggccaggatcaccgacggattccccgccagggcccgggcgatggagacccgctgctgctggccgccagagagctggctgggcaggttcttccgcttgtcagccagacctacccgctccagagactggatggcccgttcgcggcgctcctctgcggagacgccggcgtacagcagcggcagctccacattttcctgcaccgtcagcttggggatcaggttatactgctggaagataaagcccagcattttgttgcggatctccgcctgctggtcgtcctccatggtggacacatcaatgcccccaagtggtaggttcccgacgtgggaacgtccaggcagccgataatgttcatggccgtggacttgccggaaccggaggagcctacgatggccacgaactccccctgatccaccgtcaggttgatgccgtccagggcgtggacggtctcctctcccatgtggtagatcttgtagatgtctttcagttcaatgagatggctcacgggatcagcctcccatcatcatgtccatcaaactggaagcctggttgctgatgaggaccacatcgccctcctccaggccgtcggtaacctcgatatactcgtcatcgttccgacccagggtgacctccttggtctccagcttggtgacgtccaccacgctcaaaccgtcctcactgagggcgccggggccgggaacagtcaccgtgttgccccgttccaccgcatccacggggatgcacagggcgttggggaccacttcgccgatgatctgagcggagacattcatgcccggccgcagatcgccgtagtcctcaatgatgatggtgacgggatagctggtggcaccgttggcggtagtgccgttgatgctgaccttatccaccacgccggagaacgtctggccctccagagcgtcggcggtgatccgcacctcctgccccacttctaccttgccgatgtccagttcatccactgccatctccagctccagatagctcaggtcgtaaatcaccgccagcgtgccggaggaagcgccgtccaccttgtcgccggccttgaagttcttctcaatcacggtgccggcaatgggagatttgatgttgtagtcatccactgcgccggaggcagtgctggcagagagctgggcggactggaggttcagccgtgcgctctcgatctggtcccggatggtctcggactccacagtgcacagcacctcgcccttggtcaccgtgctgccggccagcttggagaaatcgttcaccgtgccggaaccggaggcatacaccacagaagaggcgggcatggacaccggagcctggccgtagctggaatagctgccgatgatggcggaggcagtgacggcgtcggacaccgtaccgggattgttcagccgcacccggacggagacggcctccttgccgttgctggtgatggtggtggagttggagacataggtcaccgtgcccatctgagagccggcgtagccgtccacaaacacggtggcggcctgccccacatagaagtcactgggggaggcaaaggggaacaggaagtcgatggacagctccgtgctggccacgatcttcgccagctgcgtcccagcggtgacgctctcgccgttgtggacgtagatctcgctcaccgtgccggagatgggcgccgtggggtgcagggcctcctgggcctgctgataggacatctgggcctgctgcacggagatctgggcccggtccatggaatcctgggcgtcgctgctgtccatggtgtagagcagggtgtccttggtcacaaggtcgccctcttcaaagggagcgctgacgatatcgccggagagcagggtggtgacgttgtaagagtccgccggctgcagcgtggcggtgccggagacgctgaccgtcagatcctgccgggtgacggtggacaccagatagctgctgctgagttgggtgttgacgtttttggtcagtctggacacgcagcccgccacaatggcgatcaccactaccaaaataatcagaattttcagccagcgcttctttttcttgccgccaaagcccttcagggagaatttctttttctccgtcttttccggcgcgggcacgctgggcgcctcggcggaggtctcgttcatccattcagtttccatgttatgtaatctccttgttctcgatttccgcggtggggcgcttccccataccgcgcttgaagatgttcagaatgttttccaggcgatcccgggtcccgggatcgccaccggcctgcaggccggtgtaaatcatgggagccgccacaaccagcagtgtgcccaggatgtcgcccaggtcccggtcctgccgcaggtccagcaggtccggattcaccgcgccgcccaggcgctggagaagcgtttccgcatccagcatttccagcagcccattcttctgcatcccgctgttgcagcggatgattccggtcatggcgccgatctctcccaggtgctgattgtcgatttttgcctgcacgtaatcatacagatccaacagcgcctgaaaaatgtcgccgccgtttcggagcagaaactcctccagcagcatgaacaactgatccacatatcccttcagcagatagcggaacaggtcctccttatcctgaaagtacatgtaaaagctgccccgggggatgcctgcctccttgatgatctggttgatggacgcctcgttgaaaggccggtgggaaaactcccgggtggccgcctccaacaacttctcctgcttttccgccggcagattcaaaaaagtgctgctcggcacgctgtttcatcctctcttatacgaaatagaaggtccgttttcttcagcgccgcccctgattttataccttcctcccgggggaaggtcaaggggtttccggcgaatggaaaaaagaaacatgacaacctgtcgcttatcatagctgacaagttgtcatattgcaagagggaattgcgaaaattcacaaatatttcacagtgtttccgtcacttcatacagaggtcggacccgctgatagggctgaggccggtactccaccgaagcgatccgccgtccggagacaccgtacttgggggagtagccgaatagatccacataccgatccaaatcgtcccgctccgccgccatggcctccagcagcaccgctgcggcccgggcgtcatccaccgcccggtggctgttcaccgcctgatcctccaatccgtaggctgtgatggcatcgttgagcttgtgagggtaatcccgccggtcccggtacaccgtgaggacatccagaaaccggggtgcccgcaggacatccgcccgcccgaagggccgcaggaaatgatagaggaagttcagatcgaactgggcgttgtaggccgccagcagcgtccgctctcccccgcccaacaggttgcagaacgcctcacaggcgtcggccttctccacgccctcctgttccagctgctcttccgtgatgccggtgagctgggtgataaagggcggcagcgtccgccccggggagaggcggagcagcaggtccatgcagtccgtctctccctccgcggaaaaggcggcggcccccagctcgatgatctcgtcccgcccgaattcgatgccggtggtctccgtgtcgaataccacgatccggtcaaattgcttccaaaggcctgtctccatggcagtccctcctgtcgaatgttgtcttttcagaatagggcggccagccggaattgtcaagggggtgccgccgttgactttctcccccgggccggataaaatgaaggcagaatctcggagaggagggtactctgtgaagcgcggacttgacaccgcctcctaaaatcaaccaattattttaggaggcttatatgaacgacaatttctgcccgtcccacactgtggtggaactggatacctgggaacgaggccctgtattccgtcattttatcgacgacctgcgctgtgtcatgagcctgacggtggatctggagatctcccgattcctgaagcagctttcggccagtggcttccgcttctaccccgccatgatctgggcggtgtccaacgtgctcaacgcccacgcggagttccggtacggctgggacgatcaggggcgactggtcctctgggaccggatcgagccctactacgcccacttccacccggacagggagacctttgcgaagctggtgacgcccttctcttcggacctggagaccttccaccgccgctttctggaggatcggacacggtacgccgccctggaccacttcgacctgacggacgtgccgcccaacacctttgatgtgtcgtgcctgccctgggtccggtaccgcagcttcgacatgcacatcttcgacagcggcacctatctggccccggtggtcacctggggaaaatatgaacgggagggagaccggacgatcctgcccgtctccctgaatatccaccacgccgtggcggacggattccatctgtcccggtttttcctggagctacaggagctgctggacgcacctgaaataagctaaaacagacaccgggcggcccgctttcgggccgcccggtgtaataatttttcaattacttccagatactcttccggatgactcggtacaggagaatcatagctgccaaaattccgagccaaattgctccgttaacggcgagtgcaaactccagcggccaaccagtccgggaattggcagtaatggtataaatgacatcttttaccgccagatagagccaaagtagtccaccgcaggcccagagaagatcaaagacgtgctttttcaaactcttcatccgctcccaggccgtttaatcgttgaacttgtcgatttggacgctgtcgcagtactgggctttcagctcctgaagacggccgaagatctccgtctggcagtgggcctgctggagctccggcgtggtccagctctccaccagcagcaggtcgtccggtgcctccgccgccaggaagtagtcgtacttcaggttcccctcctctttcagggagttggcccggatgcccaaatcacagagggcctgataaaaggcctccctttggccggacttgcagtgataggtgacgttccaagttaacataagatatccccttccattttatggtcaaatttcttcacttgcgcactctgtttccgtcaaaagctccggcgccagccgggccatgtccgccgggatgggcgccgtcagggacagatgctctcccgtcaccggatggtccagatccagagcgtaggcgtggagggccggccgagggatcaggtccgggtcctcttccccgtacagccagtcccctgccagggggcagccgatggaggccatgtgcacccggagctgatgggtccgccctgtctccggccgcagccgcaggagggacaggccgttcgacctccccagcacctcataatgggtgacggcccgggcaccgtcaggccggacgcaccggcccaccacagaattcgggtcccggccgatgggggcgtcgatggtgccggatttcggatccggacagccgatgcacaccgcccggtactcccggcaaaacctctccgtgtggagcgcgtaccggagccggtcgtggatgtagccgctcttggctaccaccatcagtccggtggtgcccttgtccagccggttcaccgggtggaacacgaagtccgcgccccgctgccaggccagggctccggccacggtgggcgtgtccggcaggaaattggaggcgtgggccgtcataccggcaggcttgttcaccaccagcagatggccatcctcccagacgatgggcaggggccagggccccggcgtggggcgcacccggggcggacggtggtcgctagtctccacctccagcacgtcaccggtgtgaaggatatccactgtacgggcatggatgccgttaacccggatgccgttctccgtccgggtcagccgggatatggcgtgggaggagacatggagcgcagccttcaggatatgccggaccgtggcgccgtcctgttccggcggcagggtatatgaaatcgtctccatcagacacctctccttcggcgcagcagaaaaatcccaagcggcagacaggcggcgtccaaggcggagaacacaccccacagaccgctccagtaccaggccgccgtgtcgaacatggccaccagcagccgatgccagaaaagcagctccgccgcgatggcgaggaggtcgaacagcacgtatccaccgcccagcaggtaggcccccgcccccggtgcaggcagaacagaaggaacgacagggctcaaaaggccggaactcctgcatggcaaaacctcatttctctgttattgtactctgacgccactctgtttgcaagggttttggctctggtaaaacgccatccttcatggtacaataggagcagtttttttcaggaggaactcccatgctcttatccgcagaacatctctccatcaacttcggcagccgccagctgctggatgatgtgaatttctatctcaacgagggggacaaggtgggcgttatcggcatcaacggcaccggcaagtccacctttttgaaggttctctccggcgtcacggagccggacggcggcaccatctcccggaaccccaacgtccaggtcagtctgctgcctcagaacccggcaatggaggaatccgccacggtgctggagcaggtcttcctccacttccccgccgagttccgggagctgaatgagtatgaggccaaggccatgctgaaccggctggggatcacagactttgcccagaaggtggggacgctctccggcggccagcggaagcgggtggccctggcggcggccctgatccacccggcggacgtgctgattctggacgagcccaccaaccacttggacagcgagatggtagcctggctggaggactggctccgccggttcaagggcggcctggtcatggtgacccatgaccggtacttcctggagcgggtggtgaaccacatcacggagctctcccaggggaagctgtaccactatgaggccaactactccaagtacctggagctgcgggagcagcgggcagagatggtggaggccagtgagcgcaagcgccagtctatcctccgggtggagcgggagtggatcatgcggggctgcaaggcccggaccaccaagtccaaagagcggatccagcggtacgaggccctgctgaaccaggaggcaccggaaacggacgaggccgtgcagatggcggcggcctccagccgcctggggaagaagatcatcgagctgcgggatgtgtccaaggcctttgacggccgtcccatcgtcagccgcttctcctacaacctgctgcgcggtgaccgcatcggcatcgtgggccgcaacggcgccgggaagtccaccctgctccacctgatggcaggcgaactggcaccggacagcggcacggtggaggtgggcgccaccgtgaagatcggccacttctcccaggagggacgagagctggacctgaaccagcgggtctacgactttatccacgacatcgccgatgaggtcaggaccgatgagggcaccttctccgccaaccagatgatggagcggttcctcttccccggtgatcttcagtctgtgcccatcgggcggctctccggcggggagcggcggcggctgtatctgctgtccgtgctgatggaagcccccaacgtgctgctgttggacgagcccaccaacgacctggacgtgaccaccctctccattttggaggattatctcctgggcttccccggccccattctggcggtatcccatgaccggttcttcctggacaagctggcggagtccattttcgaggtccggggagacggggagatccaccggttcaccggcaactggacggactggcaggccaagcgccgggcggaagaggccccctctcccaaggcggaaaagcccaagcccgcggcagagcgtccccgggaacggaaactgaaattcaccttcaaggagcagcgggaatttgagaccatcgacgcggacctggcggagctggaggctcagatcaccgcctgccagacggagcaggagagctgcggcagcgactatgtgaagctccaggagctccaggcccgtcaggcggagctggaggccgctctggaggaaaagacggagcggtgggtatatctgaatgagctgaaagaacagatcgacgcgcagaatgggtgaggggcctttcatcaggaatcggcgttctgcaccgtacgtacaagtattctgtcaaggggcggtatctcggcggaatagcactttacgccttgtgttatgaatatcaaaatcgcggaggcccttccaggcgttggacctggaaaaagaggggcattgcctgtgggcaagacgatgtccatactctctgcgaagcattggagataccacgcggcacactctgcaatcacattcttcgcaacaaacgagcgaatgcccagtttgagaaacgcagggaggaataccgccttctgatctgtgaggtctttgctgaatatcggcaggtacttggcgctgaaaagatttggatgattctcgcacggcgcgggcatcaggtcggcgccaaatttggcgctgacctgatgcgggagatggggttatccagagtttgaaactgcgagaaccggaggagaagaaaataccctccgtcagcaattttcagcagacaagcaatcaaatccgggccagtgatgtggcctgttttaagtatagagaatcgatatctttatatctgcgtgatcttggagctattttcccgtaaagtgatcgcgcacaaagtttcccgaaaaacagcacgcagctcattacggctacattacaaaatggcgtatgagttgcgtaagccagagacaggattcatttttcacagtgactgcggattttgtttgactttgcaaaaggccgatggatttccgtaaggagctgatggccgtgagacacagaggttcagacttagaaaatcagactgcttgcagccagaatttgaactgttcccatttttatgtcacattttactttcgaatacctttcctcaaaaaagcttgtgctgcaaggatttcgcacataaaacagccctacctaatctgataagtcctacaaacttgttcagattgggtagggtcgtttctcttattctatcaatcgaacttaggtgcggaaacctcgtttccagcaaaggtattggggccgggattggagagggagaaatacattttcgccgccttggtcgtaccaaaatcccggttggagccactgtcctgcacctcgttgaaggcatcccggaacatctggttgtgagcctcctcccggttgagcaggaagtcgatggtttcacggaccttcttgtcgtcgatctggcggtacaggtattcatagaccaccttggcccgctgctcagaagcgatgttgctgagcaggtccgcacacagatcgccggtcacggtcacataatcgccggtccaggaatagccggaggcattgattaagccggggttcaggcccaagatcacatggctctggatctcgcccgccttgacctgatctgcatctacatcgtggccgttgagcagattaatggtctgggccaccatttccatgtgtcccagttcctctgctgcgatatccagaaacaggtccttgatcttctggtccttgatgcggaagctctgggacagatactgcatagccgctttcagctcaccgttgccgcctcccagctgctcctgcagcaatgctgcatactggggattcggccgctccacggccaccggatggaataactgcttttcatgcttaaacatatctaccgctcctttttcgtggtaattcttagtttgcttgatatgctccgaaatataccggcagaaagcggctcaggagatgctaggccgaatcaaggaatagggccatcagtcgcggaactgcagctagagcaaacaattttaccgcgtacatttacaaagcaatcgataaaaccgagcggtgaatcattttatcgctgttcaaaatgggaagcaatgattaataatcggcagcagaaatcggtgataaacacaaagatgaaaaaatgggaatctctacctcagggaccatgctaaaaccggagcttccgccattgttgagatatcggtcaaaaacctttcctgagcgacggaaaaggtaagatctgtcggatcattcgctgtgcctatgcttgtccacagttcagcaaactgcttcaggaatacgaagcaggcggcaaagatgctgtggatgataaaatcatccacacgcttcgcaaaagattccccacagctaaaatcatgcccgacctccttgtagaagcccaacacagtacggtccggatctttgaagttatgaaggcaatcacggaaaagaaggataagccgtgaatgcaatcgcagaatttctaagagaggaaagagtaaccttttccgtaataccacagccagatgcctttgcgtgaaggtgttgacatgggcaaacgggaatgtgaaatgctgcgcagtgcgctggcctctacccgttatgaatacccccgcccaaactgaacagatatctgtcaccgttcagtttgggtgggggtattcaaggagcgccgggtatgggcggccgcctttgtccgcttatctctccgcttggacagccatgcctctgtctcatcaaacatgcgtctcaaccggttcatcagttcctctcccagccgctccgagaacgccccacagagtttcttcctgctcagatgtgcctgttccagaagccagtccagtttctggttcaactcgtctctttccgctttcagacactcatattccgcccgtgaaatggttaccatctccaggggtgcttgtcccgtgatttcttccgtttttcatgggtgaattatgctatattggggccaaagcgttcaaaacctccagtgctttcagccgtttcctaccccaattatatgtaggccactccccgggcggcgaacctttgaccgctccattttcaacccctccatcagccagcggtatcgctgcggcgtcaaccgccgtacctccttttcgttttgcggccgttggtatgcgcctgttccagccgcttatagcttatacagcaggatgcatccatcccggtccctgcagaactccctgatgcagtccagccgtctgccgcagagcagaaacagcgtattggtgaacgggtccggtttaaaccgttgctgcaccatggccgccaccccatcgattcctttccgcagatccgtatagctgcaggcgagatatataccttgtctgctctggtgaagttacgcagcatgatttcagtacctggcaaatcgtccacactgcagccgtgtccgcacctgaatagatgcctgctttcccttttccgttccggatgcttgcaaccactccaccccctctctcccgctcaggcagcaatgggagttctacttcgccttatccgtccctacctttgacagttacatcacctataccgtgatgtacgatgcggagggaaatgatctgtccaccatggcaggcatctggacgtcggcatcattgatacgagggctctgcggcccgaactgacacgcggcgatacccagtccatgcccaaaaaggggaacgggccaaccttgcggatggcccgttcccctttttcaggaaatttggaggaaaagaagtatatctatatgaattttattgcggatgtactgtgaatacatctccgtcaaatgtaatatgtacaacatccgcatttttcagagcgaccgctttctcagaggaaccgagggcttctgcaagcagttggacggccaattccgaagacactaccagaacattgccgccgccgtggctgtaagtttcctcacagattgtctggagggcgcccgtgagacgctggcgggcgctttcatagttttctgtcataccggtcttgtctgcggctgcatatgcggcgagacgggcatgggcagtgggctcttcccctgccaaagcatccgcaaccgcacgcaattctccgtcaaaatagccgcagcccaccccacgcagatccatgttctgattgaccatgagatcgggatttaccgcgctgttttccacgatgatccgtgcggtatggatatccttgaattgatcgctggcatacacggccgcaaactccagattccccagtgcctttccaagttccgcagcctgtgcctgaccgttctctgtcagtgcagtatccagctgcccattcaaacgcatagcggcatctgccgcggtttcggcatgaacggttagataaatctccaccggatcaggagattccattttttcctgggctttctgtgcatagctcagatcattaaaatccaaaacggtgtatgtatggtctttgtactcaatcaggacaatactggagttgtccagcggctccagttcctgctcctgcataatctctgctgcgatcatgctgttgattccaccgtgggccaccatcaagatatttccgccgccgttttgggccctttcctcacagatcctctggaaactttcaaaggcccggtctttcatctgctcataactctcggccagtccctccggatccttttcatggaactggtttgtgaattcctcagttgtcacaccgctgaactgcataccctcgtccgtcatcagttcggcataactcatcggctcataggagccgccatcgacctctttcaggtcttcgacaggtatgatctccagatctctggatgtctgactctgggagaggatgatgcgcgcagtttcctgggtgcggcccagcgtactggcataggcggcttcaaacttgacgccggagagccccaggcccacggcatatgctaccttgcgaccttcctctgtaagcggcgtgttgccgcggccgctgacaaagcggccggtctgattcgtcaaagtctgcccgtgacgggtgagatagacgtataccggcgcctcttccacagccccatcctgaacgggctcctgcacaggagctgtgtcggggggctgctgggaacaggcggacagcagcacacaggccagacagaatatactaaatgtcttaaacagacgtttcatggcaacaagcctccttacttgccctgatagcccagatcgtttacctttttagggatggaaaaggattcagagatgtcgtgcaacggagcccacacttggttgaagaaggggctgcgggcggcgacggctccataattccaagcattgcgctcgcactccgggcaccagtgccctccctttaatatcaggttcggactggcctcaaattcgtgtccgaacgcgcaacgccagcgcacgggcctgtagaaatcaccggcggtataatcgaggcaggcaccgccacggaactccgcggcttccttcatgtcgttcagccccagctgctccagtggcttgctctcatcatagccgtggttcagatagaccggtgtgcggctgggctcggggaattccacctcatcccagctttttggctgtgccaaggctgccgcccggcttccaaaaaaggcgcgcacccagtcatcgtgtccctcttccagcatccacagcgttcccatctcctgatgggcaatctgctcgtgcatggccttcatccgctcctttgtaggcagggccgcagcatccccgtttgcaatcatcgtctccatggcctgccacgcgccagcgatatactgctgataggtcatcacacggaacctcaggatatcattgagtgcgtctgagtccgtataccactggccatggaaattgaatcgggcaaaccatcggggctcaaatacatccttgaatccaaagccaaagggtttcagcatatcatcaaagtattgtatatagttcagccgaaagctctcgccgccgccaatgttgtaaatgccccgccagaacttctccgggacccaatcctcacatacgtttgccaggaggagcccagactcgatggaagtcacccattccaaaagattctgcggcggctgatggaaaatgatcggttcccgggctgccgactccttggagggcataattcctgtttgacgcagactcacccaatgcttgagcccggactcaatgaccgctctctcggcggcgattttagagactgcgtaatagtcaaatgcagatcccttgatgggatctccgcaacgcccccagtggatagggggcagacggcagccggtctctgccactgttccgatatagaccagtttgatcgcatccggatctggttgtgccttgatcgcccggatgatattcatagtcgatccaaggttgacctcaagactgcgctgcggcagtttatcggcttcgggagaaacgaacgcccccacatgcaacacataatccgcgcctgtcacacagcgcaggatatcgtcgtagcagcagaggtccccccagacaatctccaacgcagcgtcatgttcatagcgggacataaatgctttgttcttagcggaaggccggaccaaaacgcgaaggttgaagcggtcggaccgggataggatctgcttgaggccctcctctcccatggtgccagtggcaccagtaagaaatatgatttttttacttaacatgcttgttcagcctccttaccttacttactgccctttttgacaatatcctcctttcaattttgaaaggaggatattgtcatgtttactctgcgcgataacacacatggtaccgggcaattttgccatctttttcttccagcagctcgccgcggcagggtatctcaataccggggtagcagatgatgtaatccagaacattgccgttgagcgagaccggcttggcactcatgggcattgagtggaaatacatattgaaaatcatgtccacgccctcttttcctctgacaaacatagggtccatgcctgcacaggtaggagcggtgtcatagaagatgcaatcgtcagcgaacagttcagcaaacagtttggagtcgtttttattgaagacttccgcataattggtcagtggattcatagttggattcctccttcaatttttatcacaatccctcggtgcgcaggaagccgtccgttccgccgtcggcaaaaatgatagcaccgcatatcgccacagactctggactcagcagaaacagagcaaccttggcaatatcatcagcaggcaggaacttgccggtgttatacagcatggggatagggtagttaatcatgttggcagagaaatccgggtcagccacaccctgatccatcagctcagtctgcgtagcgccgggagcgatggtgttcatgcggacgccgcgagctgcccaagaaccggaccagcggcgtacccagcgggcgatagcattcttggatgcctgatacgcctgatatttggcaggtccctccagtgttttaccataggcaaccgctgcgtcctcatcgttttggttcaacatgatgtccaccagttcggtgttcagctggggcagcgtggcggagtttgaggacaccaccaagatgacgtccttctttttctccaccagcggataggcgccttctgtcatttctctggcagcaaaatagttaatgctgacgatgacatccgcaggctgggtggggccaacgccggagcaggacacgaagccatccagtccatctggcgccgcagcatacagcgcctccagtacccgtccccgctctgctttcatcgccagatctgcggagatgttgacgtccgcagcgtcttcagcagcggcccttctggaaatgttgatgacatagtgtccctgagccttcagctgtctgccgattgccgcgccgatgccggatgatgctccggtgattgcgtaaattcccatattgatgagacctccttcatttttatcacttcgcaccttcagaatgcgaaggggaaaacaaatcaaatagagagggcggcccgataggcttcatggatagcgtttagagccagccgcggcgccgccagtgcgtcgcccaccacatagcagggaatccctgcttcagcgcaggtatcctgtagatcctgagagggaaccggcttggacccaatcgccatgaccacaagatctgccgcaagcatccgttccttcccatcctgctccacgataacttcgtccgcccggatttctttgcaggtggtatttaccaggacctggatatcttcctgcgccattgccatatgtgtgccgattttccgcaattgtcccagctcacccaaaactgagtctttcatctctacgaccgtcacgctggaacccttcccagccagaaattcagccacttccatgccaaccagtccgccgccgatcaccacggccttgcccgcggacacatctttctgggccagaagtttatgagactccacgacacaaccgctgtcagcacccgggatattggggataatcggcttggagccgatggcaatgatgacggcgtccggtttttctgccgcaatgagtgcgggtgtcaccggcgtgttggttcggatctccacgcccaagtcacggatgttttctgccgccatgtacgccgcccgttggaaatcgcctttccggggcgcggcaccggccagcacaaattgtccgcccagagtgtctccggcttcgcagaggattggatgatgtccgcgcttgtatagggcatctgcagcctcaatccccgcgatgccgcctccggcgattaggactttcttggcctgaggggccggacgcagagccatggtctcttcctccagaacagcgggattgcgcaggcaggtaatgtgttccagcgagggatcttccaggcagcggcagaaatagtcatagcagccctggtcgcagccgatgcagtatttgatagagttcagctttccggccttagccttgttgcagaattcgggatccgccaactgggcgcgggccatgaccacaaggtccgccttgtcctgcatcaggatatcctcggccatctccggcgtgttaatcctcccgcagggcatcgtcagcagaccggtctcccggcggatacgtgcggcaggctccacgttgaagccgtggggaatgtccacaggtgcaacttcatatacggtagctgcagtcagaatgttgccccgggagatattcagcacatccacaccagcgtctccggcgcacttgcagaaatcaatgacctcttcaatggtcaggccgccttccagcatatcatcctggcagtctatccgcatgaacaggggcatcccctccggcatattggcccgaatcgcctgaatacaggccaaaggaaactttttgcggttttcaaagctgccaccccatccgtctgtgcgccggttgatcccgccagaaaggaaagaatgcggcagatagttgtgtgcacaatggaactcaatgacgtcgatcccggcttctacgacgcggcgggccgcttggccgaacgcttcaataacggattgaatgcgctcctctgtaatgccgggaactgtatattccggagagagcggcatatctgagggaagcaaaatctgcgcctgtgggtcgcttgctacggcgaggccgccttgccacagctgaacagcgacacgaccgccagcagcgtgaactgcgctgcacagctttttcattccgggaatatatcgatcatcggcgatggagaggaagccagtaggggcgcttgcggcatccacagagcaaacctcaatggtattcagcccacagccgcccttggctcgggccacatggtaggcaatcagtttgtctgtcaccatgcgcccgtcttcgctggccgcactctcatgggtgcccatggcggacatcaccacccggttgcgcagctccaactcccggatcttgatgggagaaaatagtttctcgaatgacatttttctgcctcctcaacagctgttcctgacaattgcgcatactagatccgctctgtctaccgtctctgctctgtgggagacaaagggatatattctgtgcaattatcataagtgaactcaaattttatcttgtctgtatatttattataacagcaaaagaggctgcaaagatttgaaagaaatcacaagttacttgcagcgatccttttaaaaaaacagattcctcacaggagaatcggaacggttcttgtagatttgctctgttcttcctggcgtatttccaaaatatacttcaaggtctgtgtgcaaaaaaatccgaaatgctcccgcttttttacaaaaagaatatatgtattgagctcggagtaggtaagctgtataatcttctcaaaaaggaagaacggaggatgccgatggaacagatcgtgagaatgctggagaagccgcagcggtattttacagcccacgcctcttggtacggtgtggttcagacctataccgtctcagaaataacaccgttcttttgggaagacgagtgtgtgatgttctacgttcgctctggttcaggctttctacgagtgaaccagaccttatacccattaagccaaggctgtttttgcagtatgcaccaatttcatgtgttccggtttgaagcgtcttcagaggagcctctgtgcatggaagtgctcatctatccctacccggagatggcctactttgtcacaagctttgccgaagatgatttggcttttggggaatctacagtggttctgcctgcctgtcaggtggatcgtgagctagtcgagcaacttttaagcctctatcgagaggaagcccagtgcgcagacgaggacagtcggctgatccggctatgcatctcagatcagctgcggcttctgtatggaactgctgtctccgtggctccgcttttcccaatgcccctgtgtggtcagattttcctttatatagggcagcacagcctgaaggcactgacgcctgcctctgtggcagagtcttttcacatttccacactccagctgaaccgagaattgcgccgggtttgtctggaggggtttaacgctgtgctgcgtcatgcacaggtatgcaatgcatgcgcttgcctgctgcgcagcaatgttactggaaccatgatggcaaaatttgcagggttcaagagtgaaagtgcactatatcgggactttttgaggttgcggggagcaactccgcagcagtaccgtgaaaaaatgctgctgaatagaacccaggcccaggggctgatcaatgaccagctctcagagatccaagtctatgtgatggagaattttcgatcttcggtcacatgtgatgcctgtgcgcagaaattattcctgaccaagagtatcatcaaccgcctattgagcgaaaaatatggcccggatattacattccataaatatgtcaaccgtattcgtctgcagtttgcaacggggctactagcttccagcgacttgccgatatgtgatgttgctatggaatccggattcaactctgtgcatacattcattcgcttatttaagttggagtgtggtgagactcctgcgcaatatcgggagagaaagaagagggattacgcatgattctggaaggcgggaatatatacaatcacagtggcttgagccggaattggctgcatcaggacatgcttcccggcaatgttcaaatgcgccgccaggttgtatacaatgccactggctatcattatcaggaaggctgtcagtttattttggtagaccatggaggcgggtgcctcatagtcaatggggatgcctattccctggaggccgggagttgctgccttttgtttgttcaccacttttacagtattaaaccctcgcagtccgttccgctcacacttctttcttgcctattttcctacagcacatatacctttttaactaccatttcacaatttgattttctttctattgatgttccgtcgccaccgaactttgcgaatttttctccgcaggagatggtacatatccagcggatcgttgccgcactttccaagccgggaattggtgccaacggaaaaagcattcccttcctgctggaatggttgaccaggcttcatcggcagattggtcttaataaatatcattcaacttaaataccacaaaggctgggaattactaaaaccaaaagcttatgatgccataccccacggcccggtcagaatccgggctagccgggaggcgttcgagcgctccaatgaagaggaatgaatgtggaacggaggaggacctgctgccctattatgctctgttcggcctgccccgcaagctccggacgctggaaaagacgcttgagagtatccccaaagctggtcgcaggataccaggatgggctacttttgtgatgcctggctcctgctcacccaagtcgccggggcacaggaaacggtctgacttgtcctatccgagcagttcccgctctaccggtcggatggggcgtacgaccccacagagctggcggactggttccaccagcaggcaccggacatcgcataccgctttgaccagcgcaacggctatcctgctcatcaaaagaagatagagacagcttgggccgggacacaggagatggcgaaccagagcaattagatgaacctggccggttgtcaaattcagaacacctacctaagagacaagcaagatggcctccttaaaccggaggccatcttgcttgtctcttttcaaaaaaacctgcactcagtcaaaccatttttgttccagaagaaaagtgaattggtgtttaagaaagattcgggaattgtaaagatacctccgcggcaatcaggtaaactgaacacactatctgaatggagggattttaatatgaatatccgaattttgagtacagaacagatcaccgcttatgacacttatctgcgcatagaagagcgggccgctggcacccgggagaagtatctgcgggatgtgcaggcttttgtctgctggctgaatggagccgccgtgaccaaagaggctgtgactagctggaaggagcggctgctggccgagcaccgggcgccttccacagtaaacgcggccttgtccgccctcaacggcctgttccgttttcttggctgggaggactgccggacgcggtttgtcagggtgcagcggcggctgtttcgggacccggcccgtgaactgacccgcccggactatgaccggctgatcgccgcagcgcgggaattgggcagggaccggctggcgctggtgatggaagccatttgctccaccggcgtccgggtaagcgagatccgctatctcaccgtggaagccgttcagcggggccgggcggaaatttctctgaaagggaaagtccgtaccattcttattcccaccaagctggcccggaaactcttgaagtacgccaagaaaaataaaaccgtttccggcgagatctttctcacaggaaacggcaaaagcctttcaaggcggcagatatgggcagaaatgaagcggctgtgcgtccatgcgggcgtggaaccctccaaggtgttccctcacaacctgcgccattgttttgccacggcctactaccgggcctaccgggatatcgcaaaactggcggacgtactggggcatagttccatcgaaacaacccgcatctatctcctaacctccggggcagagcaccagcggcagctcgaccgtctggggctggtgtcataggcggagttaacattccgcacagatagcacaaacgccgggatatacccggcgaaaactgaattaacattccgccccaaacaaaacggtttttctacctgcgggactatatacataaagaaattataccatttctattctcgaaaagcaaggaacttcctaacttccgggcatggaaaagcaagccgcaaaaggagattttttgcggcttggttttgtgcgcctcctgctctccttttattgggagcagggggctttattttttgtgcttggtccttctgctgggcacttgtgcgctaaaactgtggtcagaatgttaattctgacgctgcgaggtgatagatgtgccattggaaaagagccaggaaaggccgagcctttccgagaatacggaacgcctcagcaggccgggactgcgcctgacagacgagctggaactgcgttttctggaaaacctgcgggagcatgggcggacaaaggggacaatcagcacctaccgccgcaacctctccaagctgcggaaatacctgccggaggacagcaatctggaccccgcctttctctccagctggcagtcggaactgttggagcagggctattcccccggcaccgtaaatagctgcacggccacagtcaacggtcttttggagtttgccggacggcgggatctccaggcgggtcagatccctataaacggggaagtgtcttcgccggagctgacccggaatgaatatctccggttgctccaggcggcgaaactcctgaagaaacgccagacttatctgctggtgctgctgtttggcacaatggacctgccgcttcgctccctgtcccgtgtgactgtggaggccgtacaggaaggatgggtgtttgctccacggcggttgcgtgtcccgccctgcctgcgcgcggagctgctggcctatgccggggagcgggggatcgggagcggcccggtgttctgcacccggtacggtaagctgatggaccgtggaaatattaacgtccgcatccaatcgctggcccgcgacgcgcgggtatcggcggaaaaatgtaacccccggtgcctgcgaaaattatgtactgccacgcaagagagcatccgggccaatctggagctgctggccgagcagacgtatgaccgcctgctggaaaaggagtctttgactgcaggttggagcgactgctacaagggaggtgaggagttatgaacggtggaattcctttggcgggggcgtttcaatgcctggccaggcagccgccggaggccggatagaggcattatggagggaattgaagctccataggaaaaacaccgatttttgcagaccgcggctgtgtgccaaatccaggtctgtgcaaggaggaagataccatgaaaaggcgactgttggcaatggtcctttcgctggctatgctgatggggctgctccccacggctgcgctggcggcgggcagcgggggccttctggcggtgccccgtatcaggatctgggccagagagaggaaggggcggtgtctgcggccaagtttaccatctacaaggatggcgtgaaaggcgactcccctaaagaaaatgtgcaggctggtcagttgagcgaaaccgcgcccgatctgaccggggaaaacctttacttcgatcacgccgaggtgaacgggaagcgcgtgtatgaagcgggcactctgacggggcaggatatcacctactacggctccatcagcggggcactgtccattctgggcgagagcgaaaccattgacctttactatgtctccaagtatccggtaacgtatcatgtgaccggcgcggagaagaccgccggggacgatctggtgaagaagggtgactccctgacctttcgggcaatgccgtcggccaagggacaacgactggtcgtaaaggcaggagatactgacatttccaacaccggtacagtctttggccaggacaccggtgaaatgctctttacggtggataacgtacagaacgaactgactattacgatcaccgagacagctgcaacatcatataccttttcatataatacaactgacggcgcattccgcaatggccgcattaccagcggtaacaataatcagagcataacgccgggcggaacgatcacttttagaattgagtcaacagcgggcagcctgttaaatcggtacacattgaatatgctggtcatcaacggccacgaggttcagactcctggcacagagaccggcgagggtgcttatgtagagtctacccttccaagcggcgaaacagtacggataactctggtgcaggaggacactacagcagctccaattcattatcagaatgattatgaggttacgatatccgatgtgtacactgacctctatatcagcgaaggtaattttaagcgcacagacagaaacgaggtcatcatcaaggaactgtccggcataggaaatattgtgggctgggacgatggcgctgaggaatatgttccgggaagcgtaaaccatgtgtatctccagacgggcagaaccggcaacgagttctacttcaatctcaagccaggctatgaaaaaccgcagcttaccgtcaaggtcaacggtcaggtaagcgaagcggagatgaattttgaaaagaatatcggaaatctgcacgacgggagagaaccgagctatacgcaggagcaatatcagtaccgctttgatcttcccaatggcttgggagacaacatagagcttttcctgaccgcgactcccatcacctattcggtggaataccggaatgataggaataacaacgacctgattggcgaaccagagacgggcttcacagtggtggagggcaacaaggataccatcaccatcaccagccggacaccttatgagacggtaaaggggtattcgccggatggctacgttgtaagaggaaccagtgccccagtgtatcacgccggcgatattgtagatgtaaaagatgtagccgccgatgccgctgggaccaccatcatctttgtaccacactgggttcctgtgaatgaagtgaacgagcggaatatcaccatcaacctgtacatcgaagacccgaccgacatcaacggcagtgacattccggcggcgaactacctgcgcacggtggcggagggcgacgccctgttcagaccgaacgaggaacgtggccgggagcatatccgagagtatattagcagctctgatgagccgtggaaagacacttataacgatgaggactttgtgctgcgagagggtggagagatccaagtcgttaaggaatcggttagctccttagatttccactttgatgtgaaaaagggcaacctgacggtgaaattccagtggggtgcgggtgagcagcccgacaccgcggtgcctgctctgccagagaatatcacagagcaaattgccatcaagcaggcattttctgtggatgtgagtgagtccataccggagggctatactgcttctacgacaaccgttgcggggacgatgatcgaagcgggtgtggagaaaaccgtttacctgtacaaggatgcggacaatgacaataagccggacaaccacaccatcaccctgacgtttaatgccggtgaaaacggaatcattgatcctaataatctgacatccggcggagcactgtcagaggatcaaaagaccctgacctacaagctggtaaaaccagtggaaggcgaactggagggcgacaagtatccgcagatcccgcaggtcaacgcaacggcggacagtatggtctggacgggctggttcaacaataaaaatgaatccagccgctacgccgactatgcgaaccaacccgtcggtgcagacgcggcagatctcacctttgatgcgcattacgacgctgccgaaggccataaagaagttgccatccgctattacaccgagcaggagagcggagagtttggcctcgcccgtacccttaccagttaccggaaacccggcgaaactgttacatacggccgccctgcccgtaacggctatgtgacttccaatgaggggacatccggcagcctgaccgtgaccgaggatggaccaaataccgccgatgtctattattatcttgacacggacaacaacgacaagccggatacctacacggtgacgctgaccttccggggcaccggctatggcagttgggatattgaggacaccatgtgggagcagatggaggcaggaaaggattacatctatgacacggactcccgtgctctgaaagtattccttgtaaaagcaaacgaagcaggctttgaggcggagacctatcccgaggcccccaaagtaattcccgaagatacctacctgtttgactcctggcaggatgacagcaagcacgcctatggctccggcacggagggcgacggcatcaccgttggaagttccgtgggggcggaagacgccaacaagagctacacgtcggtctacaacgaggataagaacaacgacgaaaagcccgacgacgagcagtacattacgatcaccttccgggctggggagcacgggacgtttgccgatagcgaaaagacagtgacttatgataagctgctgccgggctacagctcttatccggaggcccctgccgtgacagcaagcacgggctggcagtttgcgggctggagtccggaatacgataagagcggaacaatagaagcgactgtacaggaaagccaaatgtacacggcgacttatcgcgggcaaggcacgctgacctatggcggcaacgcacagagcggcggagaggttttcgacctgccggatgagcagaccgtttgggaaggaaccaccgtggagctaagcggccaaacgccaacccacacccccgtcaacgaaacatccgttgtattcatcggctggtccagaacgaaaaccggccaaatctatggcgaggaggatcaggaagcgtttgagaagatcgcgttgttgcctggcagggtttacatcgacagcacggctttgacgatctacgccgtatggggctatgatactgatggcaaccagaagccggatgtgacggaacccacggaaaagcccaacctgatcaatgtcgtaccgcctgcggcaatcaccgtggaaaacggcaccgccattgaggagatggggcttccaacgcaggtgacgattcagaccacgaagggcgatatgcaggctaatgttacgtgggatactcaaaacacaagctatgatcccagcaaggcagaggcgcagaccttcaccctgaacggcacgctcacgctgccggagggcgtcacgaacacgaacagcattcccttgatgaccaccatcagcatcaccgtgaatgccaaggatgtggaacccggccccgatccttctgcgtcctacaccctgacctacgatgccaacggcggtttcggcgggccggggcaggagaaagtaagcgcggatgaagcggaaaactatcaactgaacaccaccgacaaaccgactcacaagacggctgaagatggcaccatgatcatcttcatcggctggagcgctgagcaggacactaaaatctacggcgcttccgataaggacggcccgaataccattgacaagctcaccctgactgccaacgatgaagtttatgccgtctggggctatgacgccaacgagaacggcgcgcccgacgtggaggaagacggcaagtacaccctggcctatgacggcaatgccatcaacgacggtgatcaagtcgctggcgtccccgacggcggagaaatcaagtatgtttccgggcaggtcgcagttctggacaccgaagaacccacctacaccttggcgccagccacggatgactccgctgtgattcccagccccacagacgagccggagacagagacgctccccagtggagagtccgcaggtgaggaagagcccacagagagcgaacctgccgcaaccgatcctgttgaggaatccatccctaccgaggagagcgccccccccgtagaaaccactcccgcgcatgtgcccgagttagcctccatcggcatgacgcgcctctcctaccgcagtgcgggcgatggcagcggcgacagcgtggtgttcatcggttggtccctcaaccagcacagacagattttcaagggaaccgataccgaagctttcaagtatgtacaaatcgttcccgccgtgaccttcgacgatgaagacatcaccgtgtacgctgtctggggctatgattccgacaacgatggcacagccgacgtgctgggcgagaattatgtgattcgctcctatgccggtcccaacggcagcatcgatccgagcggagacaccaccgttgcagagggcggcgaccaaggctttacctttattcccgactccggctatgcggtggataagatcgtcattgacggtgacacgtatctgaacgacggcaacctcaatctggccggctatgatgcggacagcaagacctacaccttcaccaatgtgcaggccgaccgcagcatcgtcgtgaccttctccgccgatgcggacagcgacggcgttcccgacaagtacgatcccgcgccaagcgagagatacactgtcaccgccagagtaaacgacggtaacggcaccattactcccgtcagcaagaccgttgacgcgggcgatgatgttgtattcaccattaccgcctatggaggttacgcactagactacatcactgtggacggcaaggtggtctactccaacaatgatgcagaaaatccattcaaggatacctggacgctcaagaacgtgcaggcaaacagcgaagttgtggcctactttggcgaggatcagaacggcgacgacgttcccgatgcgccgacctacctgaccgtcacggcgcgggccggtgaaaacggctccatcagccccagcggcaccttgctggtgaagcgaggcgagagtcagagcttcagcatcactgcaagctccgactaccatatctccgatgtggcagtaaacggcgtaagcgtgggcgcggtcagcagctatgagatgataagcatctccgagaacatgaccatcacggccagcttcgcccgcgacagcagcggcggcggaagtcacaccacccgctacaccatcacggccagcgccggtaagggcggagagatcagccctgacggaagcgttcgcgtggtccgtggcagcagcaaaacctttaccattaccccggatgcgggctatgtgatcgaggatgtgctggtggacggcgagagcgtcggcgctgtggataagtacacctttgagaatgtgcgtgaaaagcacaccatcgaggcggtctttgccgagcagaacggcggtgtggcagacccggacgacaccggcgtatctggctggctgaacaccaaggaccacagtgcctatctcggcggttatggcggcgggtggtttgggcctgacgataacatgacccgcgcccaggtggcgcagatgttctataacctcctgctcaataagaatgtgcccatcacggtcagcttctccgacgtggccccggacgcatggtatgccgaggcggtcaataccttgggcagtctgggcatcgtcgccggtatcggcaacgggcaatttgcccccgaccgggcgatcacccgtgcggagttcaccgtgatcgctatgcgctttgcagaactggacaccagtggggagaacatctttacggatgtatccgagaacgactggttctatgactatgtggtaggcgcgatcaagtatggctggatcaccggctactccgatggccgcttcggtccttacgacaccatcacccgcgcccaggtgaccaccatcgtcaaccggatgctggaccgcagtgcggatgaagcctatgtggaccgccacgcagatgaactggaacagttcaccgatgtgccggacactcactgggcttactacgaggtcgcagaggccaccaatgcccacgactacgaccgcaccagcggcagcgaagactggacacagctctggtaagcatactgaacagtacggaggaaagggacttcgttccctttcctccgtatgcataaataaaataaggagttctttaagccgtaatatacttaattgccgcattgccgcctttgcagaaatggaagaaggcggcaatgcatcccacttcaataccgctctgttaaaacacagcatccctctgccggatgggcctgctgaatcattggagaagcacatgacaaatccggaaaccttttgcggtgtgccgtaataccccatttttcttgtaactactcattcgttttatccattgccgagaagtgcactgccggacaattggcattggaacatctttttagattccgtttataatttgctgtcttaacttttggctttaggcccatgaaacacacgggttctattttgtatccccctttctttcacgcaggagaggatgcctgttgacatcccctcttttttacttccctcttcctcctgtctccttggcaggacgcagttctgcactggaggaagaaaactcaagtacgagacctacctcaagcttatcatcgccaccgggatgcggcagggcgactactgcgcgatctgcaagggggtgacatcaactggcaagagcacatctcatcggttcagacagctgtttcatgcgcacactgtagtacaatccttctccaattcatggcgtccccatgacaacgctgtcgccgagccattctccgccacactaaaacaggaagagctttaccggaaggattatacctccgaggcagacttcaaacaatgtcttgcctcctgcatcgagtacatcgagctttacagcacacagcggccgcatcgcacgttgaaaaaccgcataccctgtcgggtggaagaggcattcatgaacagcaagtgaaggggagcggtgtgctgacatatcaggggttcgaatctggccgattacatgttttgtattttgattttgtcctgtttgtattttgcagatgacacaaggcaagaactataggaaattctgacctccttgcagtgcaaaaagttcaggcataaattgcccctacccaatccaaacaatgacatgcatttgttcagatcggataggggcattcacaatggtggaggtgaggggagttgaacccctgtccgaaagcactttaacgggactttctccgggcgcagacggttattgcgggagtctttctccctgttccccttccggatggcaagccgtcacgccgtccggtcaggtgagagtcatcatgcgtgggcggggcaactcttacccgccgcacggacgccacatcaacgacgccttccccggcctgtggccactccggttcagacggccgcctttaattaggcagcaatagcaacttgtctgttgttatttgatttataaattgcccgttttatggcggtcaggcgccgccgcccgctggtcccgcctccatacccccgtcgaaaccggtacacccccctgtcgtcgggacagactgtgctctacccgctcccggctgcaccgagagctcgcaatgctccgttgtccctccacttcccatcacaaacgcttcactggtttgtgatgggagcctgcgattcgcatctccatgccgagggcctttctgggatatctggcaggataccaatggagattgtaacacatcccgctgtcggaatgtgttacaattccatgacatttcaggttttggtaaattttaccatcagcttcaccggcgcgactttggccagcaaccggtagaatttgtagaacagccgcggcgtgtacatagtcctgcccgccttggcggcccgcagcgcgcccgccgctacccgcacctggtcgcagtaaggcaggtactcaaaggccggggaacggccagtgatgctgcccacgtccaggaactccgttttcatggggccggggcacaccgccgtaacggtaatgtcccttcgcttcagctcttcactgaggcccacagtgaaggaggacacatacgccttgctagcgccgtacaccgtcatccggggcgtggggcagaaggatgcgatggaagacgtgttgaggatgcgtcccccgccggcatatagggaatgaccaggttcgtcatcgccgtcatggccctgacgttcagatctaccatccgggtctggacagcggtctccgtctcccccatccggcccaggtaaccgcagccggcgttgttgatgaggatcgccacctccggtttctccgccgccagtttttcctgcagggtggtaaaggacatggaatcgcacaggtccaagggaaggcagaccgtctccacccccaccatctcccgggcgatctcctccagccggtcctcccggcgggcaatgagccagcagcactcaatctccgggaatatgtccgtcagctggcgggcaaactcccgtcccagaccggaggacgcgccggtgatgatggccgtcttcattgggctctccccctctcagcgcttttcaggctccggatagtccacgccctgggtgtccacccgaatgctctgaatgaccaccggtgtcttgggcttgtcgttccagtcggtggggacctccgagatgcggatggcctcctccacgtttccggtcacctggccgaaggcggcgtactgcccgtccaaatggggcgccggggccaccatgatgaagaactggctgccggcggagtccggatgcatggcccgggccatggacagcacgccggtggtgtgcttcaggtcgttctggacaaagccgttgccggagaactcgccccggatgtcatagccggggccgcccatgccgttgccgtcggggcagccgccctggatcatgaagccggggatgacccggtggaagatcaggccgtcataaaagcccttgttggccagggagatgaagttggccaccgtgttgggagccttggcggggtatagctcgccggtcatcacagcgccgttttccatggtgatggtgacaatagggttcgtcatgtcagacatatcatcgattcctttcttttagggtgcggtcaatctcccgcttggcgtcccgctgggaggcagccgcccgcttgtcatagttcttcttgccccggcacaggccgatctccagcttcacccgggaatccttaaaatagacggacaggggcaccagggcatagccgtcctgcttcaccagggcatggagcttgcggatctctcgtttgtgcatcagcagccgccgggagcgcaccgggtcccggttgaagatgttgcccttctcatagggggagatgtgcatcccatggacgaacagctccccatcctttaccgtacagtaggcgtccttcaaattcagcgttccggcccggatggacttgacctccgtgcccgcaagctcgatgcccgcctcgtaccggtcctccacgaagtagtcgtggaaggccttgcggttctgggccgcgatcttgattcccttcttctccgtggggctcacctctttcctggaaggttttattataataccatattttccccgcatcttcaagagaaagtcacagttggctttttctggaggatatgctataataaagtgattgagtatgtcctgaatatacaaaaaatagacacaaggtggaatgctatatgaatcagactgcggatctgacggagaagaccctcagccgggaggaaaagtaccagggaagcttcctgagcctgcacgtggaccaggtgcagctgccgaacggcaggacctctttccgcgaggtagtagagcatgtggacggcgtggccattctggccctggacgaccggaacaatgtgctcaccgtcacccagtaccgctatgtgatcggaaagacgctgctggagatccccgccggaaagctggagccgggcgaggacccggtggccggtgccctgcgggagctgaaggaggagaccggtgccgtgccggacaccttcctgcccatgggcgtgaccctgccctcccccggctgtctcagtgagcggctgtacctcttcctggcaaagggcctgcacatggagtcccagcagttggacgaggatgaattcttgaatgtggagcgcattcccttcaatgagatggtccaccgcgtcatggacggggagatcgaggacagcaagaccatcgccgccgtgctgaaggcaaaagtgcttctgaatctttgagaggagactctgccatgagcgatccgaaaaccgtcctgatcgtggaggacgagaagaatatcgtggacatcctgcggttcaatctccagcgggcgggctatcagacgctggaggcctatgacggagaggacggcctggctcaggcggtatccgccaatccggacctgatcctgctggatgtaatgctgcccaagaaaaacggctttgacgtgtgccgcgccctgcgggatcagggcagcagcgttcccgtcatcatcctcaccgcccgggaggaggaggcggacaaggtcctggggctggagatcggtgccgacgactatatcaccaagcccttctctatgcgggagctggtggcccgggtaggagccaacatccggcggaccaccatgacgccgccggctgccgcctctgccgcggcctccgccatgcccgtgtccggggatttgtctatcaataccgacagccaccaggtcttccgggccggtaaggccatcgacctgacccagcgggagtatgagctgctgacctttctggccagccatcccaacaaggtctactcccgcatcgacctgatggagcaggtgtggaactacggctatgtgggcgacgacgtgcggaccgtggacgtgacggtccggcgcctgcgggagaagatcgaggccgaccccgccaatcctgtcttcatcctcacccgccggggcgccggctactacttctccgtgaaatgactccgccccccattctctaaggaaagaaggtgttcgccgtgttccgcagcctgcacatgaagctgatgctgattctgctgctgctcatcacctcgctgatggcggtggtaggtgcattcctgaccaccagcgtctccagcttctatatcgacaccttttacgagcagatcagcgccgtgttcagcgacgacagcgacggctatgtctccaccctccgggcccgggcggccgaaccggacggcgccgccggcatcaaggagatgctggagggccgggccggctccctgggcatcgactaccgcacccggaactacttcatcctggatgggcagagcggcacctacctggacgggtctgcagaggcgtcagagctcccccgggagcagaccgccaacctgctgaccgcccggaatgccgtggctcagggcgacagcaccctggtgggagaccgcagcgacatcaccgccgactatatggacgcagccatccccatcatggggggcggaaacgcctacatcatttacatcctggacaacaaggacacagtgacggacctgaactcccagctcttcctcatcatcatgcaggcgctggtgatcggcctgctgatctctgtcctgttgagcttcctgctgtccaagaccatggtgggccccatcgaaaagctcaccgccggggcagagcgggtggccgcgggagactttgacagccagctccccgtggagtccactgacgagatcggcatcctcacgggcaccttcaacgagatggccgatgtccttcaagccacgctggccgccgtggagaacgagcggaacaagctggacaccctgttcctccacatgaccgacggcgtggtggcctttgaccacgacagcctccttatccactgcaatcccgccgccaccaatatgctccatcgcagtgtgccggagggcactacctacgataccctcttcggtcaggtctatcccttccaggagaccctggccctccaaagacccaactacgccgaggcggagatggaggtgggggaccggacgctggagctgtttctggcgccgttttccgaccaggccagcggcggcgtgctggtggtgcttcatgacgtgacggagcagcaccgcaacgaggagcggcgcaaggagttcgtggccaatgtctcccacgagctgcgcacccccctcaccaacgtccgcagctatgccgagaccctgcgggacgcggagggagacatccctgtggagacctccaacagctttctggacatcatcatcacggagacggaccgcatgacccacattgttcaggatctgctgaccctcagccgcctggatgcgggcaatgcggagctggtgctctcccgctttcctttcggggacgccattgagagcgtcacccgtgccaatgccctggccgccaagcagcacgggcacacgctgacctatactccgccggagagcctgcccttgatcgtgggggaccggagccggctggagcaggtgatgatgaacgtcatcggcaatgccgtcaaatatacgcccgacggcggacacatcaccatcaccgccggctccacagaggcggaggtctggatggaggtctgcgatgacggcatcggcatcccagagaaggatcgggaccggatcttcgaccgcttttatcgggtggacaaggcccgttcccgggagtccggcggcacgggcctgggtctctccatcgccagggagatcgtccagcgccaccacggcaccatcgccctggcgccccacgagggccccggcaccaccatccggctgacgctgcccatcggcgggccctccaaccccatctgagaaagtcacatccgcaaaaccgctgaaaggaggctgcccatggatcaaacggcccggcgcaggcgccgcaacctcatccagaacatcgccatcgcgcttctgtccgtctcggcggtgctcctgttcgcccagctgcagctgtacaatctgggcacgtcggaggacccgctctatctggagcggctgaccggcgagggctcaccctcccggctgcgggagtttcccgctccggtacgggtggtcctcacggactcctacggccggtatggcagcctgggcttcactaccaacagtgacggcttctccgccctgggcctgcgggaggctctgggctccgtccagcaccttgctccttctgcaacggatgcctttcggggtgccctctcgggcccttccatctattttgattttttgaatcccctgcccctccaggtgcttgccgagctcaccggtgcagagggcaccgcgttggagggaaatgcccgctgtctgctgctggccgcaggggcggacggctccgtccatctctatgtatgggacggtgctgataccgtcctcaccggcaccgtcgcctccaccgccctctccatagattctcttacagaggcagtgagccagtccggcatgggaagcgtctccttcgcctttgaggttgtggagatggagccgctatacggcaagctgtttcccctctccatcctgccgacggagttaccgcagctgccggtcctctctgccgcttcatccatctccggcacggactggctgctggcggctttcggcttcaacatcaacacgcgggagcgctatgcggaggccgacggcacggaggtcatcaccgaggtcgaagccgatcgctcccttcacatccgtccctccggggagatcacctaccgcagcggaacagatgctacgctggagatctccgcacaggaggaggtccccactgcggcggaagccgtgctgggtgccagtatcctgctggaacagctgacagaggaccgctccggcgaggcaaggctgtatctggagtccgtcagtcagggcggagacaccacccagcttctgttcggatatcagatcgatggtgtccccattcgcttctccgacggcggacacgccgccgagatcacgctctccggcaccagcgtcacccgcctcaccctgcggttccggcagtacagcaccgccggggagacgtcgctcctgctgccgctgcggcagacgctggccattgcagcggagcatcccggcacagagctgtctgtgggctatgccgacggcggcggagactcggtatccgccagctggctggcggactgagtgcagcggatacaagccgctccggcggtggaaaggaggtccgacggatggagagcttccgtctgaaaaacatcatcattctgatcctggctctgatgaatctctgcctcctgggcctgctgggagtacggctgaccaccggctattccgcccaggcagaggcccgtcagcagatggtgcagctgttcgcggcggagggtgtctctctggatgacggcattatccccggcgccacaccgcccgccggcctgaccttgtccagggacccggacgaggatgagaagctggccggctttctcctgggagatgagctggtcatgtctgatggtggcggcggcgtcaccacctatcaaagcgaaaacggcagcgccgtcttccggtccgacggcacctttgacgtggtgatcgaacagagcggcgagacagcggacgccctgtgccgggccttctgccgtgcgttccactacgaagccctcgccttctccctggatggggaggacggcagcgcctccgcggtccagacctacgacggggccccggtggtcaactgcaccgtctccttctccatctccggcgggcgggtggcctccgtcagcggtacccacctgccccaggcgggacagaccgccaatgggaacggtgccctgtccgctctggatgccctcaatgccttcctcggcaccgttcagagcggcgcggtggtcactgccgtgacggacctgtacctctgttatgagctgcagagcaccacagccactcctatggccctggtgcccgcctggtgcgtttctacggatacggctgattattatgtcaactgctacaccggcgcggtctcctccggctgagtaactggagccctgccgggcagataatttgtttccaaatttctccgcctgtgcgccgcgattcggcctgaagcggctgttttcagccgtcggcggctttggaattttgacgaattttgacgcggaacccgtccggctcgcaggaagggtttgcattttgcgcggggatatggtatagtttgggtgtgtgagcttccccatccggaaaatttctccggtttcgcaggtctttagcgggtatgaagcggcacgggccgggcacactgtttcatagaaattacaggtgccgccacaaaagaaagcgccttttgaagagagggtatcgactttgacaaagtatattgtacagggtggtcatcccctgtttggtgaagtagagatcagcggcgccaaaaacgccgccgttgccatcattcccgccgctctgctggtggacggggtctgccggatcgaaaatatcccccagatctccgatgtgacgctgtccctgaagattctggagcatttgggtgccggcatccgcgtcatcaaccgccatacagtggagatcgacgccagccgcatccgctccacccgaacctcctatgagttggcccggaagatgcgggcctcctattatctgattggttctctcctgggccgcttcggccaggcggaggtcgccatgcccggcggctgcaacttcggggtgcgccccatcgaccagcacgtgaagggctttaccgcgcttggcgccaaggtcatggtggagggcggcttcatcaacgcttccacggagaccggccgcctcaagggcgccaacatctatttggatgtggtctccgtgggcgctaccatgaatatcatgatggccgccgtccgggcggaaggcaacaccgtcatcgagaacgctgccaaggagcctcatatcgtggacctggccaacttcctcaactcgatgggcgccaacatccggggtgccggcacggacaccattaaaattcagggcgtggaccgcctgcggggcggcagctacgccatcattcccgaccagattgaggcaggcacctatatggccgccgtggctgccaccggcggccagatcctggtgaagaatatcatccccaagcacatggattgcatcaccgccaagctggtggagatgggcgtggaggtagaggagcgggaggacacccttctggtccgccgcagcggccccttgcagaaggccaatgtgaaaaccatgccctatccgggcttccccacagatatgcagccccagatcaccaccgtcctctgcctggcggagggcacttccctggtgacggagagcgtctggaacaaccgctaccgctatgtggatgagctcaagcgcatgggcgccagcatccaggtagacgacaagaccgctgtggtggagggtgtggaccatctcaccggtgcgcccatccaggcctgcgatctgcgggccggcgcggcattggtgatcgctgccctggctgccaagggcgagagcgagatcagctgcgtacagtatatcgagcggggctatgaggatatcgtcaccaagctccagggccttggcgcttccatccgtaccgtggaggtccccggtgagtccgaggagctggaggctcacattggctgaaacggggtacaggcttctctaggtttcccccgctgccgcggggttatacaatcaagacatttccatagatcgagcgattttacgtccgcgatggaggatggcgactttcgtcgacggcctcccttgtggacgtcttacttttcaccggaagaggtatgttttttgaccaccgtacatacgctggcaagcggttcctccgggaacgcgctgctgctctcctgcggggagagctatattctgctggatgcgggcatttcctgccgccgcatcactgccgctttgcgggagctgggcctggagctcggaagcctcacggccattctcatcacgcacacccacgcggaccacatctccggcctgcagacgctgctcaagcgctgcgccgccccggtttttaccaccgagcgggccgcccgggagctatcctggcggctgcccggcgcagagacacggctggacgcgctggacttcggcatcccccagtctatcggagagtttgccgtgacggcatttcccacatcccatgacgctcccggttcctgtggtttccggctggacgccgccggcggcgccgtcggtgtcctgacggataccggctacgtcaccgacgaggctgccgacattctggagggcgtggatctggcggtgctggaggccaaccacgacatcgagaccctccgcagcgggccctacccctactatttgaaacagcggattctgggcgcacaaggccatctcagcaatgaggatgccgcccgttttgccgccgttctggcgcagagcggcacatcagagatcatcctggcccatctgagccgggagaataatacgcccgccatggcgcaaactgccgtagaacgggctctctccgccgcaggtgtctcgcctctgctgtctgtggctcccagggactgcctgggcccagcccacaccgtgagcaggaggtccgtatgcagaaggtgacgatcctgtgtgtcggaaagctgaaggagaaattttatatagacgccgcggcggagtacgtcaagcggctgtcccgcttctgtaagctggagctggtagaactgccggaggagcggctgccggaggacccctcccccgcccagatcgaggcggcccttttgaaggaggctgctgccatccgggccaagctcccatccggcgccgccctgatcgctctgtgcgtggagggagagccgcggtccagcgaggcgctggcccggcagatggctgcctgggccagccagggcgtgggacatctggtgtttctcatcggcgggtcctttggcctgcacccctccatcaaagcagaggccaggctgcggctctccatgtctcccatgaccttcccccaccatctggcccgggtgatggtgctggaacagatctaccgggcgtatcagatcaacgcaggcaccaaatatcacaagtaaaggacgtggaactatgacagaaccggcaaaggacttctgggcccgggcggaccgggacctgctggaccgctggccgaaagacgaggcaggcgcaccggaacccgccgccaagctggacatccagtgggagctagacagccaggcggacatcactgtgtcgtttttggaaagctgcggcatccccgccttccagaatgggtccctgggcaaggtgctgggaggcttcgcctcccagggagtagagatttgggtccccgcctcccaactggaggaggcccaggcgctgctgaacacccccgcggaaatcccggagcaggactaatgtcccgcctccgttctcaatttacacaacaggaggtatctctcgcatggattttatgaaggaatatgaaaagtggctggcgagtcctgccctgtccgacgcggagcgtgcggagctggagagcatccgaaatgaccccaaggagattgagagccggttctacggcccgctggagttcggcaccgccggcctgcggggcatcatggccgtgggcctgcacaacatgaacatccatgtgatccgctgggccacccagggctttgcccaggtcatctgcgccgagggcgaggagggcaagcgccggggcgtggccatctgtatggactgccggaaccactccatggagttcgcccgggcggcggcggaggtctgcgccgccaacggtatccatgtgcggatcttcgagtccctccgccccacgccggagctgagcttcgccgtgcgggagtaccgctgccaggcgggcatcaatgtcaccgccagccacaatccgaaggagtacaatggctacaaggtctactgggaggacggcgcccagctgccccctcaccacgccgacgccatcgccgctgctctggaacagatcgacgtcttcaatggcatccggcgcatggacttcgacgaggcggtgaaggccggcctcattgagactatgggggaggagacggaccggaagtttatggccaacgtcactgccatgattaacgacaaggaaaccgtggccaaggtggcggacaccttcaagctggtgtacactcccttccacggctgcggctacaagctggtgccggaggcattgcggaccctgggcatcaagcacctgatctgtgagcccaagcagatggtgatcgacggcgacttccccaccgtggtctcccccaacccggagaacccggagggcttctatctggccatcgacctggcccgggagaatgacgtggacttcatcctgggcactgacccggacagcgaccgggtgggcatcatgatccggaaccacagcggcgagtaccgccccgtcaccggaaatcagaccggcgtgttgctgctggactacctcatcggcgccatgcgccgctccggcaaaatgccggagaagcccgtggccctcaagaccatcgtcaccacggagatggcccggaaggtggctgagtccaacggcgtcacctgctacgacaccttcactggcttcaagttcatggcggagaagaagaacgccctggaggccgccggcgaaggaaaggtcatcttctcctatgaggagagctacggctacatgctgggcgactacgtccgggacaaggacgccgtcaccgcctccatgctgctgacggagatggccgcctggtacgccgcccagggcatgacgctgttcgacgccctggagaagctatacgagaagtatggtcactacgccgaaaagacctacaacctggtgatgcccggcctggacggtctgaaggatatggcgcagctgatgaagaatctccgggagaatcccccggcggagatctccggcgtgaaagtcgtcacccggaaggactacaccgacgggtccgtggtggactgcgccaccggtgcgaagagcgccatggagctctccggctccaacgtgctgcggttcgagctggcggacggcaccaccattctggtgcgaccctccggcacggagcccaagatcaaggtgtatattctgacccagggcgcggattctgccgcctgtgacgccaatctggagaagtacggccagtgggtcaagacgctgcaaaaataagacgtcccttcttagtatccaaacaacggcgcccgttcctttcggaacgggcgccgctttttgggttttcagaaccaggccgcctgctgctcccggaaccggggctccgggccgtgggcgtaggggtcgtaacggcccaggttgcagccgaactcctggagacgggcgatctgccccgttgccgtccagcggaccagggtcataccctcgaacacctcccggcggccgtcgtccatccggttggcgaaggtccactccaccaccgtctggtcccccttgtggaagaactggcggatatcccaccgctccaccgtgccccggcgattccactcggtgaaccaccaggcgatcttgtccgcgccgtggtactccgggccccagctctcgatgtacaccgcgtccggggcgaaaaggtcccggatgccggtgtcccgcttggtgagccacatgtcgaaccattggcagatggccgcttcccgctgttccatctgattgctcctttccgctgtatctgctcttatctataagcaaaatgaattaggatgcgaggatgttctgaacctccgccagcagggtctccccgtcgtgcaggggatagccgtccaccgcaaagcgcccctgactgcccaccaggatgacggattccccattggcacccaggagcatgacggtatccgcttccagaggatataccccaacgggattcttccagcggaacctagaggccccccgcattgtagcctccaggtccgccagctgctccggccggagcgacgccgtcaaatcccgtccgtcctgccggacctccagcagctggaagtcctctccccctgccggggcgggtagcaggaagaaatagccagccagggctgccacggccacaacacataccagcagaactttccatgttcttttcatatgcgccccttctttgtcactgctccggcaacagggcccaaagctgttccaggagttcttcgccattgatgaggggataccgtctgtcaccatcataaattacggcggtgtcctcgtccagatagatatgccatagcccctcactgtctctcccgttgatctccacactgctctccgagagccatggagagcagccaacacggtaccccctctttccgcgcccagcaccagtcccttgatggcgtctaaagtatcctgatcgatctgttccgtgatgtcctctagtgtctcccctgctctgatgaagctgatttcaaagtcccctcccaccgcagggtagtgcaggacataccgtgcgcagattcccacagtcatggccgccaccgctgccactaccacaacgcacgccagcaaaattttccattttcttttcacaggcgcatccctcccctgtcacggctccggcagcagggcccagacctgtttcagcagcccttcgccgtcaataatggggtagccgcccctttgtccgtcgcagagtacgcaagcttcgccgtccagctcaaagaaccagggtccatggctgtcgacgcctatgatctgcaccgtgtcctcccgcagctgccttggaaagacgtttctgcggtacccccttctctctgcttgccgaagcaggtcattgagggcgttacaggtattctggtctatctgaccggtaatattctccagcgtctctcccacattgatatactggacttcgtagtcctcccctaccgcggggcggggaaggagataccacgccgcagcacatgctgccgtcactgccacgacgcacgccagcaggattttccacttctttttcaagagaaccgccccctctctggctccatcataaagggaccgccctgggcctgtcaaggcggaacgcagatttttccaacgttattcttgacatatgttcaaaatcatatataatgggcatatgttcaaaacaagggaggaacacccatgccgcgcagcgccaaatgccgccgggtctgccagatgccggcccactgccgctttgctccggaacagcccgcccacggggaggccgtggagctgacagtggaggagtatgaggcggtgcgtctgatggattacctgggcctgaaccaggaggaggcctccgcccagatgggggtggcccggactaccgttcagcggatctatgcccaggcccgacagaagctggcggtctttctggtggaaggccgtccgctgcagatcggcggcggcagctacgccctctgtccccaggaaagttgccggggcttcagcaggccctgcggccggtgtgcctcccaagacggaaaggaagcgtcctcatgaaaatcgcagtcacctatgaaaacggccaggtgttccagcactttggccacacggcacagttcaagctctatgatgtggagaacggcaccgtagcctcctcccaggtggtggataccaatggcagcggacacggggccctggctggctttttgaaggaccatcaggtggatgccctgatctgcggcggcatcggcggtggggcccagatggcgttggcggaggcaggtatccggctgtacgccggctgccagggcgacgcggacacccgggtggcagaactgctggcaggcacgctggtcagcgccgatgcagccacctgcgaccatcaccacggtgaggagcacacctgcggcgaccacggctgcggccaccacgagagcggccatacctgcggccactgctgagaccggaccgggagggcgaaacgccctcccggtttttgtgcagcaccttttggaaatatgggattccctttctgcataggatgggaacagcggactttgacacttcgccggaaaggatgatccccttggagcaatacatggaacagcattatcccttcaccctgccgcccctgccctacggctatgacgcgctggcgccggagctgatcgaaaaagtgctgtatttccatcacgacaagcacttcgccgcctatgtggacgctctgaaccagctgctggagcggacgcccgcctatcagtcctggccgctttggaagctgtgcctaaactgggaggaactgccggatggcctgcgacagggcgttcggaacaacgccggaggcgtctttaatcatgacctgtatttccgcaccctccaccccctgccggtctccgccccggacatggcgctggagggcgctgtggtacgggacttcggcggcatggcaggtttgaaggaggccatgcgcaaggcggccctggggcaattcggctccggctgggcctggctatccgcagacggcgaggggcacctggctgtccaaaagaccgcaaaccaggacacaccgctgcccctgatccccttgctgtgttgcgacgtatgggagcacgcctactatctccaataccagaatcgccgggcggactacttcgaagcctggtggcgactggtggactggcctgaggtctcccggctctataccggctgcctggcctgccgtccgccccggccctgatggaagattccagaggcggcggcaatcgccgccgcttttggaaaactccagaaaataggcgttgacaactgcttccttttccgttatgataatatgtcgaatgaagacgcagaggaaggagcgtacccatgaatttcttgctgaccggcggggctgttttccgggatggaactttccagaatgtggatgttgccatttccaaaggccgtattgtttccgtttctccctccctttcccaggaaggtttttccgtaattgaatgtcaggatcaagtcattgttccaggtttcgttgatgtacatgttcatcttcgggagcctggattttcttataaggaaaccatcgcctccggcacggcggcggccgccgcaggaggctacacggcggtgtgcgccatgcccaacctgaatccggtgccggactccctggagcacctgtggccggagctggacgccatcgcccgggacggccgggtgcgggtgtatccctatggggccatcacccggggcgaaaaaggcgcggagctggcggacatgccggctatggagccctttgtctgcggcttctccgacgacgggaaaggcgtccagtccgccgaccagatgcgcgatgccatggaactcgcaaaacagctggacaagcccatcactgcccactgtgaggacgagtccctgctgactcccggctggtgcatccacgacggggagtgggcgaagcggaacggcttccccggcaacgcccctgagagcgagtggaaacaggtggagcgggatctggagctggtgcgggagaccggctgccggtaccacgtgtgccatgtctccaccaaggagagcgtggccctcatccgcaaggccaaggcggaggggctgccggtatcctgcgagaccgggccccactacctgatcctctgcgacgaggacctgatggatgacggccggttcaagatgaatccccccatccgctccgccgcggaccgggatgctttgatcgaagggctgctggacggcaccatcgactgcatcgccacggaccacgccccccacagcgcggaggagaagtctaggggactccgcagcctcaacggcatcgtggggttggagtgtgccttcccggtgctgtatacggagctggtggagccgggcatcgtccccttcgccacgctgctgaacgccctgtgcgtcaatccccggcggctgttccgcctgcccggcggaaagatcgaggcgggagagatcgcggatctgaccgtgctggatctgaaccggccccatgccatcaacagcggtgccttcttctcccggggccgctccacgccctttgacggctggaccgtcaccgccggagtggacaagaccatctgcaacgggaatctggtgtacaccgccagctcccgcaacatcaataagacccccattcccccctgtcaggaggactacctatgaaacaatccctctttaccatggaacacgcccggcagctgaccgccgacacctatgagctggtgctgtccggcgacacctccgccatcacggcgccggggcagttcgtgaacatccagttgcccggcaaattcctccggcggcctatctccatctgcaactggacgaaggacgccctgctgctcctggtccgggtggtgggcgaaggcacccatgacttagtgcggtgcgtccccggcacagagctggatgtgctgtcgggtctcggcaacggctttgatctggcaaagggcggggcccaccccatcctgctgggcggcggcatcggcatcgcgcccctgtacggcctggcccagcggatgctggaggcgggcatcgcccccacagtgggactgggattccgctccggcggagacgccttttacctggaggaattcggcaagctgggctgccgcctgatggtggccacggaggacggcagcttgggcacaaagggatttgttacggatctggcccgtcacgtgccggagtgcggctacgccttcgtctgcggccccacccccatgctgaaggccgtccacggcctgccccagctcaccggcgggcagttcagcttcgaggcccggatgggctgcggcttcggcgcctgcatgggctgctccgtgcccacgggaaacggctacaagcgggtgtgcaaggacggtcccattctgtacaaggaggaaatcgtatggtaagcctgtctgtccgccttgcaggggtggagctgaaaaatcccgtaatccccgcctccggcaccttcggctatggccgggagtacgcagagctgtatgacctggacctcctgggcagcttctcctggaagggcactaccgcacagagccgtccgggcaaccctcagccccggatcgcggagaccgcctccgggatgctgaacgccgtgggcctccagaaccccggcatcgacgcggtgatcgcggaggaggtgcccaacattgcaaagatctttcatgggccggtgatcgccaacgtgggggcttctctcttcaggagtacgctgagaactgcgccaagctcaacgacgtggagcaggtgtccattctggaagtgaacatctcctgtcccaacgtccacgccggcggcaggaactttggctccgatccaaaagctgcggcggaggtgactagggccgtgaaggctgtcacccggaagccggtcttcatgaagctctcccccaacgtcacggacatcgcggagatcgcaagggcctgcgctgacgcgggagccgacggcatctgcctcatcaacaccctgttggggatgcggatcgacctgaaaacgaaaaagcccctcatcgccaaccgcaccggcggactgtccggccccgcggtgttcccggtggcggtgcggatggtgtgggacgtgtacgaggcggtgcagctgcccatcatcggctgcggcggcgtctcctctgcggaggacgtgtgtgagatgatgctggcgggggccagcgccgtggagatcggcgccgccaacctgcgggacccctatgcctgcaagaagatcatcgaagccctgccgggcgtgtgcgaaaggctgggcgtggagcgtatcgcggacctgaccggcgcggcgcacggctgaacgctgtcaccgagaaatttacagaaaggactgtttgaatatgagcgcaaaagacgtcatcatcgccctggacttccccacccgtgaggagaccctctccttcctggaccagttccccgccggggagaagccctttgtgaagatcggcatggagctgttctatgccgagggcccccaggtggtccgggacatcaaggcccggggccacaagatcttcctggacctgaagctccacgacatccccaacaccgtgaagcgggccatggcggtcctctcccgactggatgtggatatggtgaacctccacgccgccgggacctctgagatgatgcgggccgccctggagggcctgactcgtcccgacggcacccgccccctgctgattgccgtcacccagctgacctccaccgacgccgccgccttgaaaaacgagctgctgatcgacacccccatggcagagacggtgctctcctacgccaagaacgccgccgccagcggcctggacggcgtggtctgctctcctctggaggcggctctggtcaaggagcgttgcggcgcggacttcctgaccgtcacccccggcatccggttcgcggacagtgccgccggcgaccagaagcggatcatgaccccggagaaggcgggcaagtccggctgcgactacatcgtggtgggccgtcccatcacccaggcggaggacccggtggccgcttatcggagagcggtcaaggacttttggggctgagcggaacgggggcacgtctgcatgaaatttgatttgatggaacttgcccttgtcattgctgtctttttcatggtactggcattcggagtaatctggatcaaagccctgccattcggttataccgagtcggcgctattgtaccttgcagccattgtggccgcaagtgctttctgggtcggccgaaagcactgaccatcttcgcacatttggataaggaggatttttccatgaacttagaacgtgaaatcgcccacgatctgctgagcatcggcgcggtgttcctgcggccggacgagcccttcacctgggccagcggcatcaagagccccatctactgcgacaaccgcctgaccctcaccgctcccgccgtccgcacggccgtggagaagggcttggtggagctgatccgcacccattacccggatgcggaggtgctgatgggcacgtccaccgccggcatcgctcacgcggccatcgtgggccacctgatggacctgcccatgggctacgtccgctccggcaacaaggaccacggccgccagaaccgcatcgagggcaggctggagaagggccagaaggtcgttgtggtggaggacctgatctccaccgccggcagctgcattgaagttgtagaggcgctgcgggaggcgggtgccgaggttctcggcgtcgcatccatcttcacttacgggctccaaaagggcctggaccggctggccgccgcgaacgtcgtcaaccactccctctccaacttcgatgccgtctgcgaggtggccgctgaggaggggaagatcaagccggaggacattgagcggctgaagaggttccgggccaacccatccgacgaatcctggatcacgtcgaaataaattccgctcattccgcttccggctttgccgggagctattccctgccgcccgaggagcggctccctcccaccacacccctgaaaggagttcatcatgcccagaaatctcatcgacatcaccgacctctccgtggaggagatcaatcagctgatcgccactgcggaggacattatcgccaacccggtcaagtaccaggacgcctgtgcccacaagcagctggcaacgctcttcttcgagccctccacccggacccggctctcctttgagtccgccatgctggccctgggcggcagcaccctgggcttttctgaggccagctccagctccaccgccaagggcgagaccgtgggcgacaccatccacaccgtcagctgctacgccgacatcatcgccatgcgccatcccaaggagggtgctccctacgccgcctcccagttcagtgaggtacctatcatcaatgctggcgacggcggccacaaccatcccacccagacgctcaccgacctgctgaccatccaccgggagaaggggcggctgaacaacttcaccatcggcttctgcggcgacctgaaattcggccgcaccgtccactccctggtgaacgccctgagccggtacgatcacatcaacttcgtgctgatctcccccaccgagctgaagctgccccggtatgtgaaggaggaggctctgaagaagaagggcatcccctacacccagaccacggatctggagtccgtcatcccccagctggacattctctacatgacccgtgtccagaaggagcggttcttcaatgaggaggactacctgcgcttgaaggacagctacatcctgacaccggagaagctggagaacgccaaggcggacctgtccatcctccaccccctgccccgtgtcaacgagatcactgtggcggtggacaaggatccccgggccgcctactggagacaggtgaagaacggcaagtacatccgcatggcactgatcctgaagctgctgggcattcaggtgtgagaaggaggcattgacgctatgaacatcgacagcatccaaaacggcgtggtcctggaccacatccaggctggcaagagcatggacatctaccgctacctccatctggaccagctggactgctccgtggccatcatcaagaatgtccgcagcggccggatgggtaagaaggacatcatcaagatcgactcccctatggaggtagatctggatgtgctgggctatatcgaccccaacatcaccgtcaacatcatccgcaacggcgtgcgggtggaaaagaagcatctggagcttccgaaaaagctggtgaatgtcatccactgcaaaaacccccgctgcatcaccgtagcagagccccagctggacgccatattcctgctgagcgatcccgccactcacacctatcgctgcgcctactgtgagaccgcaaaggacaagaagttctgattccccgtgacggcactgcccgttcagactgcgtggacatccagttttttcccctccggcagggccgtatatacggattctgcattgcaggaaagttttcctgcaatgcagaattttttttgcaatttctgttgcgttttggaggaaaatggcgtatactgcggcccggatttcagaaaacggaggcactcctatgaagcatcatccctcttggaccgctctgcgcagctacgcgatcacagccggtctggcctgtctgatgggcgtcagctatgagctgtttgtctttcccaacgcctttgccccggcgggcatcaacggcctggccaccatgctgcaatacctgctgcacgtcaatatcggctacctctccctgctcatcaacctgccgctggtcctgctggcctggaaaaaagtcgaccgggacttcgcccgcaaaacgctggtgttcgtgctggtgttctccgccgtcacgctggtgctgggccagatggacctaagcgccatcgcctatgactccggctcctccgccatcctggggcctgtggcggccggtgtggtcagcggcgctgtgtacggctgggtgatccggcagaacggctccaccggcggaacggacatcgtagccgcctgggtgcggaaaaagcacccggaggccagcctggtctggctgatcttcagcctcaatgccgcggtggcggtgttgtccttcttcgtctacggctgccagttcgagccggtgatcctgtgcctgatctactgctatctcagctccagcatcagcgacaccattttgaagggcggcaaatccgccatgaaattcgaggtggtcacccggcagccggaggagctctcccggcagctcatgcagcagctgcgccacggtgtcactgtgctccaggcggagggaatgtactcggagactccccgttccctgctgatctgcgtggtgaaccgccatcaggtggttcggttccaggagattctggcccgcttcccggataccttcgcctgcgtctccagtgtcaatgagacctgggggaatttcaaacacgtggcatagaaaaaccggcggaggccgtacagcctccgccgatttttcaggtttttactccgccgcccgctccagccggtccaaggggaacggcggtgcggccagaggcttcaccgccaagctcatcagcagcatggggttatcatccgccgccacccggttggaatggagcacgccgcagatcttgcagcggtggatgatggcccactcgccgcccttgcggacccagacggccaccggctccatggtgccgccgcagtcggcggcccggtcccccggctcgtcatccaggtggacgctggcaaggcagttggggcagtggttgcggtgctgggttccggcagcctgaggtcctaccggccagccgcagacccggcaggtgaatacatcccggcagggatcctgccggtagtccaggcggcgccgtttcggtttttgcgggattcgctgggacattggaaattcctccttggtgttgtcttactgccctcagcataccctgccgcaggccggtcccgcaaccgtcaactcggttcagaaataagaaggcgccatgcgggagtccgcatggcgcttgtgttcttattcatttctcaggcgggcgatgatcttccaaatgctcttcggcgccagaaagtaggcttccgccagctggtccacagaggtcccctcccgatagcgccgatagatctcctgatttcgggccagggtctccgccttgcggccattggccgcgccccagggtttgcggctggtctcccgccgggggatgtacagatactccccgtcgatatacgcctggacctgggccagcaggtccggcggcagcacgtcggctgctttcatatagcgcatgatgctcctccaaagctcttgtgatttggaatgagcagaggctatatgccaaatctctttgtttgacgcgatagcctctgctatgcgtcaaacgccgaaacacaatgattcaattgcaactggattccctcatttccctgaccgctgcagccggttttttcagtggcaggaatttttttctgccgctgtcactataccatagatctccggggcagtcaacataaatccgttattacaggaagcaacaggaaaataccattcttggacaggtaccctaaatcctttaattatgtaacggtttatccgttcacgcacagcgcaaacgggtaaaccattatagtggaaaactcatcgtcgcaatagcgacaatgagttttccgcacaattactctcattaacctctttctggaatccatccatacttacccatttctactatattgccgtttatttcgtagtccaacctatataacacttcatccgaactcgacaaagcaaccgcttcaaatttaacatccatatcgctcctatcatctgtttttatttgtattacaacgggttgattgagaggagcttctctttgaataacagtatctccacttttgattctaatcgatctcacctctgggtcgtgagaaattgatacaacccaacccgcatccacatcttctcccacccaaaatttattaagaagttctacgccgctttctgttttttcttgtccactcgagccaacataccctctccataaaaattttgtttttttacagtaaacagtataatattgttctccagcatccacgagataaaatacgcaatttgaatttattctctcattgagcaggataactggagcttctgccggataaaaacgcacagcttttacggcgctctctggtgtaagtcgatacccaatgaagacattacttataatcgtaataactataagtatggcggccatttttaataaatttgtttttgtgttttttttcaatctttcctccaaaattatttatcacaatgcccctggtatataatatactaggggcatcgtgatggaatttactttttaccagcctgtctggaaattctgtttgtatgatgttgatgcactgtgacctacaacagatccattttcaaaatttgcatcaactgttgtagttgcactaagagaaaacgccgttgcaaatccgcttgctgcactgatttgaggccaatttagtgtcacaaaattcacattattgtatggtcccagagttctttcataaattttgcttccgcttgttaccgcaggtggccacgaaaccgatacttgcagccctgttgtttcaaatgtctcagtaatataaatggagcttggagtataatcagggcttgtataagcagctttacttaccccccaacaacccaaagatatgcgtaattattatcaatacttttacaaaatgttccagactgggatgctgttaatgaaacatctgttggagagtgttcactcgtgttgaacttctttgacgcggtagccgtagggcccgatgcaagaggcatcggagcatccgaagccatttcagattctatctccctgattgcgccttccatgtcagtctctgttaagccctcatcagtaaactcatacgttgtgacaataaatccctgatcgtcatacgttttcacagtcgtggagataccgttgatttcaatattttctgtgctaatcaatcggttgtcttctttttcaaactccgtagctgaacctgtaatgccacatgacagtaccatcacaagagccaaaaccaacgcagcaatttttttcatagaagccgcctcctttcaacatccctaataatttacaaatccggaaacactcactttgtaactggagttgtttcttaccgcaaatgtataggtccctctgagatcgatcctgatcgtctggttaatgctcccgttgcttcctcgtacagggtaaaatagcccgtcggagtcgatcagtccgaagtcgacactcgctgacgccggagaataagatgccgtaatggtaacggtttccccatattccatcggaaagctggtgcttgcttttctcatgctcttcgcagaaatctcaaaatcaaactcgcctgtggctcttggttctgcgatctctgttgcctgttctccaatatcagctgcaacggcctgagcgggaatacagctaaaaattgcaatacaggcgaacaataagcacagatatcttttcatccccattggtttcacctccttcctgttactcccaattcaagttaaaatccggctcttccaacaacgtactttcttctccctgaattgaatgtaaatccaagccattttccttctgccctcttccataccagaaaaggaagcataccagcagggccaaaacaacggcgccgatcacaagcagcctcatccactgcttttcttttttctgtaccttctgctccggcgccctctctgcagccggggccgccggagcaggaagttcgtccccgctttcatccagcaaatactccagcgggacgttatagagcctgctcagagattgcagattttctattgatggcctggacgtccctgtttcccattttgttacggcctgccgggacacatccagcttttccgatacctccgcctgggacagcccttctctttttcgcaaacaggccaattttttctctagggtcattgtttacatctccaaatctatcccagcaagaaatgaaagtaaaccgcccgcggcttactttccggcaaccaacggttgccaactgggttttttatcctttttttgaggtttccatgccccggaatgtccgctcacgctgcgccgctgcacatatcacgttggactttcaaggggggccgggcaacaccaaacagggggatgccgcctccttttcagcccggtagttggtcttgcgcacagaaccgacatcccaccccgcttggaaatcggccctatggtatcatctccggcaggggctgtcaagcctgcggtcccgggcaaaaaagcagccgcagagcgttgctctgcggctgtttcatttggttttacaggccccgccactcctccggccggaggcggctcaggtcgtgctccgccgcgtcgatggtgcggagcatggcctccttgtcccggttcagcgtgcccttcagcaccaggtagttgctggcgtgattcatccggaacacgctgccggggctgtccagatgctccatcagcagccgggtttcctccagcacctggggctgggtcagcagttggaagctgccgtcccgcacccagtcgtaaaggggcgtctccggctccaccatcagcgtcagcatcccgatatactccgggttcatggcgttgaaggcctccgccgtctcgatggcgtggcgctccagcagctccgggccgcccaggcccgtgatggcggtgacggacagcgccatgccgcaccggcggaccttccggcccatctccacgatctcggcggacatgtggcccttgcgcatccgcttcaaaacatcgtcgcacccggactccagtcccatgtagaccatggtcaggcccttgtcccgcagcgtccgcagctcctcctccgtccggatacggatggaggcaggggacgcgtagctggtaacccgctcacactctgggaacagctcccgaatggtgtccagaatggtgtaaagctcattcgctttccggaccaatgcatcgccatctgccagaaacacccggtccacccggcggtacacgccccgggcgatgcggaagtcctccagcacctcctccaggggacgaatggcgaagtgcttctccttatacatgctgcagaaggcgcaggtgttgtggctgcacccgtaggtcacctggacgatgaggctgtacgcctcagagggcggacggtaaacgcttcccttgtatctcatacgcccagcttctccagggccgccatcttcaggcagacgcacagcacggcgatggcctgctccagctcctcaacagggggcagggaaggcgcgatgcggatattgctgtcctggggatccttgccataggggaaggtggcacctgcgccggtcatggtgacgcccgcctccttgcacagggccagcgtccgcttggcggtgccgggcatggcgttcagagagacgaagtagccgcccttgggccgccgccaggaggcgatctccagcggcgcgatctcccggtccagcgcgtccaccacacagcggaacttggggcccatgatggcggcgtgcttcttcattagctccagggtgtgggccttgtccttgagatagagcacatggcgctgctggttcaccttgtcgaagctgatgacctgaacggtgaggagcttttccatgtaagccatgttggcctcggagcaggcaaagcaggagatgccggcgccgggcagggtcaccttggaggtggaggcgaactcgaacaccatgtcggcgttgccgtatttttcacactccgccaggatgtccgggaactccacatagtcccctcgaactcatggatacagtaggcattgtcccacatcagcaggaagtccggggcggcgggcttcatagaggcgatgcgccggatggtctcggcggagtagatgatgccgtcggggttggagtacttgggcacgttccacatgcccttgaccgccgggtcctggatagccttctccaccgcgtccatgtccggtccctcgtccgtcatggggatggtgacgagctcaaagccaaaggactccgtcaccttgaaatgccggtcatagccgggggcggggcacaggaacttcaccacgggctccctgcaccaggggcgctcgctgtggagcaggccatgggtataggccttggagatggtatcgtacatcagctgcaggctggcgttgccgcccacgaacacctgctccggccggcagcccaggatctccgcgaacagccgcttggcggcgggcaggccactgagttcgccgtagttacgcacgtcgacgccgtcggacacgtagtcttccggcttctgcatcaggctgaaaatatcgctgaccagatccagctgcgccttaccgggcttgccccgggccatgttcagattcagtccccgggccttcagctcctcgtactcccgggtcacctcggcgtattccgccttccgctcctcggcggtcatcttgggataagcagtcattacagcgcttcctttctgttgaaaaatctttacaaatccaattcagtatatcgttttttcaacaaacttgcaaccccatttctcctgggcgcaaacacgaaaagggccccgccgaaatgggcggggaccctgttccgctttcctcagcagccgccgcagccgatgcagctctctgcgcaggtgatggtggggtcgcaggtagaaatggtcgtgccgtagcggaccgggatggagacacagaccttctgggtcatagtcacggtgcacatggttccgtctgcattggtggcgcaggtgatggtgggattgccctgacaggtgacggtggggctgcccatgactgcggtgggggacaggatcacggaggcagtcacatccacacactgggtactgaccttgttgcagccgttcagggggcaggattcttcggactgatatggtaaaatgggctcatgctcataggcttcattgatacgcaaaggaattccctcgtttcatggaaattatatccggcgtttccgccctggatacaacccatcttatgcgcggcaacgcctgactgcgcctgtcagctctgctgaaattctgcaagggcccgccgcaggaagttcttggtctccggtccgcagaaggcggcgtccaccgccgcctcctggcaggccagcagttcctcacgactcatataggcgaattctgcggcccggcgcagctcctccgtcagggtcagcccgcccaggaaggtaggatcgtcccggctcagggtcaccaccgcccctgcatccagcagacgccgcaggggatgatcctcccgccgccggtacagcagtgtcaggttggaggtcaggcagatgttcagcggcacccgctcccgcaccagccgggccgtcaaatccgcgtcctctgccgcccggacgccgtggtccagccggtccgcctccaggagatccagggcgtcccgcacgccatccggcccgctgctctccccggcgtgggcggtgcggccgaagcccgccgcacccgccgccaggaacgccggacggaaccgctcccccgttcggcccgccagggcctcgttcccgtcaatggagaggcccgccagccggtgggtccggtgggctttcatatcctccaccagggccatggcctccgcccccgtctgggtgcgggagagagacagcgtgaatcggcagtctgcgccgccctgtgccgcagcccggtcaaacccagcggtcaccgcggcgatgatctccggtaccgagaactggggccagtgggtggggttcaggatcatctcgctgtacaggatatgctcccgtccactctccagcgcagcgtgctccgccgcctccgccagctcctccggcgtgcccacaaaggagcagatgttgtccagaaaggcgaggaagtcgctcaggtcctcagcagagcagtcgtacagccgctccgccgggcggggcagctcccgcccctgccgggccgcgaaccgcgccagcatctcccccggcatggtggactccagatggacatggagctccaccttgggcatgcgcgtcaaaaaggcagtcagatgttccattgcgtttgctcctctggttgttttttctataatgaatgtagggcaccggagggaaccaccggacccgctgttttccattataccataccggcgccgatgtgccaatccccggaaaatacccttcccttttgtcagagccgtgctataattctgttaggatcatgtaaatatttcaggaggagggctctccatgggtgaagaacaggaacagaaattccaccagctcacagaagaaccggtgagccggatgatctcccatctggccgttccctgcatcatcagtatgctggtgaccgctttttacaacatggcggacaccttttttgtggggatgctgcgcagcaacgctgccactggcgctgtgggcgtggtgttttccatgatggcggtgatccaggctgtgggctttttcttcggccacggcagcggcaacttcatctcccgggagctggggcggcgcaatacggattcggcctctaacatggcggccaccggctttttctccgccctgttcaccggactcctcatctgcgttttcggcgagatcttcctgacgcccctggccgcgttcctgggctcctcccccaccattctgccctatgccaaggactacctgcgcgtgatcctcatcggcgcgccgtggatgaccgcctccctggtactgaacaaccagctgcgcttccagggcaacgccatctacggcaccatcggcatcgccagcggcgccgtgctgaacatcgggctggatcccctgctgatcttcgtctttgacctgggagtggcgggcgccgcctgggccaccatcatcagccagttcgccgggttctgtctgctgctggcgggctgcacccggggcgccacccttcacatccacatctcccgcgtccagctgaaatggtcctacttcaagctcatcatccagggcgggctgccttccctggcccggcagagcttggccagcgtggccaccatctgcctcaaccacgccgccatgccttacggagacgcggccatcgccgccatgggcgtggtccagcggatcaccaccttcggcgcctccgccatgatcggattcggccagggcttccagccggtgtgcggcttcaactacggtgcccggctgtatcaccgggtgaaggagggcttctggttctgcgtgaaggtggccgccgtctttctgctggtgatcggggcactggggttcgcctttgcaccgcagctcatcgccctgttccgggatgacccgggggtcatcgccatcggcacggtagccctgcggttccagcgcgtgactttcttcttccaggcgtggatcaccatgagcaacatgatgctccagaccattgggcggaccgttcccgccacctttgtcgccatggcccggcagggcattttcttcattcccctggtgtggcttctctccctgtccccgttgggacttctgggcgtccagatggcccagtccgtctccgatcttctcactctggcggcggctgtccccattcaactgtatgtactgcgccagatgtcacagatgcagcccgccaagatttgaacccgaaacaggaaaaagcaccctgcggccgacggccgcggggtgctttcaggttgtcttacggtcctctcatgcgggcagcagcgcctccaccgcggcggccagcgcctcaccctcccgaatggcataactccagtccggatcctgatagacggcgaagagcccgtcctccatggagagtaccacgtgcagggcctcctctccgccgacgacgttcacctccaccatatcccggaaggaatgcgccgggagtccgccccgggaaatcagaccgcgggaggcgccctccagcagatccagcacctcgtccccgtccacctgggacgagatctcctgtccccggtaatagagcgaggtgagccggtactccacctcctcgtccaacacgggagccgacagggacagcaccaccgctccggccgccactgccagcaccgcaacgatcagcaccacaatgctctttcgcatcccatcacctcctgttttttccattatatccggctccgctccccgctgtcaagcaagaaagcgccgccaaaggcagcgcttttctgttcggctccgcggcgcggacaagctgttattccgcaggttctgcccggcgcagagcctcatccgccgccgccagctccggaaagacgggcgaccagaggcggaagcaccgcccttcgatcatgcgccggtaggcaaaggaatcccgcacccgctccggcaggaggacgccagcccggcactcgtcaccatcctcgtgggtgtcagaccctgccaagcgcagatactccgggtggcgcttcgccagctccagggcccggtcgttatggttttcatggcggggatgggcgttgaggatctccgtgccgtggacagcatcttcaaataccgtggtattgccgtcgcggtaagggtgggcgtggacgatcagtacttggtcgtggaatttccggtagaactcccgggcgctcatgcagcacagatatgggttcgcccgcagccacgtctcgtcaatgccatagaccagatagtcgttgtcgttctccgggaagcgcagctccgcccccaggatcacatccagccccagttcgtctccccgggccttggaggcccggtagccggcaagatagtggtcgatcacatggtcccagttgtggtccgtgtcaatccgggacaagtactccgggtggaggtgatctgtcaccaccaggccggaaaatccgtgcccggcatagcgatccaccacctccgccgccggcagatggccgcatttgctggtctccgccgtgtgggtgtgggggtcgtagagatactctttcatagctgatcgcctcttcttatccgtcaagcagtgcgccgcgccgcagaacggcagacgtctctcatgtcaacgccctgcaggagctgcgcttcaccagactgggcatcaggatctgatggacgtagccctgggtgccccgctcgatcttatccaacagaatctccaccgcctgaagggccatctcccgcttggactgctccaccgtagtcaggtcgatccgcggcatggcggcagatgcgatgttgtcaaatcccatcagactcagctgctccggcaccctgatcccaagctcgtccgccgcccgcagaatccccagggcgttggagtccgtggaggccaggatggccgtatagtccaggggcttggtaaacagctcccgggccagctcatagccgccggccactgaggagcggggaaagctgctgtccacaatccgcggtgtcagccccatgtcccggcaggcccgcaggtagccctctgcccgcagctggtgggtgacggtgtgcctgcggccgaagtacaggatctcccggtgccccaggctccgcaggtattccatggccaggtaggtggccccggtattgtccgtggtcacacagctgaggggttcgtcccgcagatcctcgctgaggaagaccgtgggcacctgctccgtgtagacccggagctcctcacagctccggtgctcctgggggacgatcagcatcccgtccacctggcggcccaccagcagctttaccaccgccttctcctgccgcagatccggcccggagttgcacagcatgagattgtagccccgcgcccgggcgctcatctccgcgtggtacgccagctctgccatgaactgattgtcaatagaaggcactaccagaccgatcagctccgtcctccgcatgaccatggagcgggccacatagtttttggtgtagcccatctcgtcgcacaggcgcaggatccgctcccgggtctcccgcccgatctgtgggccgcctgacagagagcgagagactgtggaataagagacgcccgccgctcgggccacgtccttcagcgtgacgttcttcatctgactctgcctttcccgccgccggtgcggcgcattctgcgcaaacgctttccccacccgccaaagccggccggaggcgtatgccgtcccatatagaatagcgaatttgccggggcttgtcaattacagaacgatgcagggccttccgccgcaagccttgccgcccgtaggtgtttctggaaaatcgaggaaaaccttgaagtgctgctttccatggttttcctttctctggagagtcactccccctgcgcctgtgtaccttcctatctccggaagttattcttgtgaaaattcaaactcatattgactccgtataggaggatggggtaaaatatagaaaatgtcagggttgatttttggtcaaaaccaccatatttttgtgcagacattgggaaatccgccgatacacgcttcttcaggttcgccccacggcaccaccggcgggacgaattttcaaaaacctttgataacccccttttcatgttttggaatttgtggtattctgaaagcgaagtaatcgttttgctttttctgttggcgcacacacattgcattctcacttctcagcgacctgtccccctgtcgaacctatgcggcgcaggtttccgcgcggcgtgcaatttaagtgaaggaaaggaagaaacaccccatgaacgaaaaaaagtgcaaagttctggcggctgagatccggctggaaacgctgaaggtcatccactcccggggcttcggccacgtgggcggctccatggacctggcggacctgatggccgtcctgtacggagaggttatgaagtttgacccgaagaacccccggtgggaggatcgggattggctggtcctgtccaagggccacgcgggccccgtggcttacgccacttttggcctgatgggctactatcccatggaggaagcttataccctcaaccatcctcacaccaagttccccagccacaccgaccggaagctgacccccggcgtggatctgaccaccggctctctgggccagggcgcctccaccgccaccggcgccgctctgggcaacaagatcgatggccgtgacagccacgtgttctgcgtcatcggcgacggcgaggccgacgagggccaagtctgggaggcattccacttcgcatacgcccacaagctggacaacatcatctacttcatcgacaacaacggctatcagctggacggccccaccgccgacatcctggaccacggcaacattgccaagaaggcggaatccttcggcctgtatacccaggagatcgacggccatgatgtgaaggctatctacgacgccatccagaacgcttacgccaagaagggcgtgcccagctgcatcgtgctggacacctgcaagggcaagggcgccactttcgctgagcccaagcacgaccactcctcccagcccaatgaggagcagtgggccgaggcgctggccgccgcggaaaaggctctggaagacgccaagaacgcttgaggagggtgagagcaatgaacgtgaaactgatcggtaagcatgaaaaggactcccgggcctgccgggacggtctcgccctgaccctggacgagatgatggcgcaggacaagtccatctgctatgtggactgcgacctgatgggctgcatcaacaccaagcggctgcgggagcactatcccgaccgggcctttgaggccggcatcgccgagggcaacgccgccggtgtgtctgcgggtctcgccgccaccggcaagaaggttttcttccactccttcggtaccttctcctcccgccggtgctatgaccagatctatatgtcagctgcctatgccgggctgacggtccatgttctgggttccgacgccggcgtcaccgccgcgttcaacggcggcacccacatgccgctggaggatgcagccatgtacctctccatccccgaaaccacagtgctggaccccgccgactatgaccagcttgccagtatcacccgccaactggtgaacatcgacaagggcgtcacctacacccggttcgtccgcaagggcatcatccaggtgtacggcgagggaagcgagttcgagatcggcaagggtgtggtgctgcatgagtccgacaaggatcaggccaccatcatcacctccggcatcatggtggacgagtccctgaaggcctatgaggctctgcaggcagagggcatctctgtccgggtcatcgacatgttcacctggaagcccctggacgaggagctggtggtcaaggccgccaaggagaccggtgccatcgtcaccgccgagaaccacaacgtcacctgcggcctgggttctgttgtggccaactgcctgtccaggaacgcccccaccgtacaggaatttgtgggcgtgcaggaccagttcggtcaggtgggtccccaggacttcctgatggacgagtacggcctccgcgccgccaacatcgtggccgccgtcaagaaggccatcgcccgcaaataagttcagatacccggcggggtccctcaggggccctgcctgtatcgccatatatcattttgaaaaggagacaagaatcatggatgctttttccgcttccctgatggctgacaagcgggagattattttcgctcccacagtgtacaagttccagaccttcgcccagatggcggaggagttcaagctgaacgagcgggacgtggtgctgaccaacgagttcatctatacccccttcatgaaggatctgggcctcaagtgccattatgtattccaggagaagttcggtgccggcgagcccagcgaggaaatgatccaggtcatgtacgacgccatcccctacgacagctacgaccgcgtcatcgccgtgggcggcggcgccattatggacctgtgcaagctgctgggctgcaagcgccccgataccgtccacaacctgtacttcaagcgattccccgtggtgcacgagaaggacgtcatcgccatccccaccacctgcggcaccggctctgagtgcaccaacatctctgtggctatcgtcaaggacgagaaggacggtgtgctcaccggcggtgagaccaagctgggcctggtgtccgacgacatcatccccaacaaggtgtgcctgatcccggagctcctcaagaccctgccctacaagcccttcgcctgctccgccatcgacgccctggtccacgccaccgagtccttcctgagcccccaccgcaagaccatgacctccgagctcttcagcgagaaggctatggatgtgattctgaaaggcttcaagctgatcgacgaaaagggccaggacgcccggttcgagtatatggatcagttcgtgaccgccagcttctacgccggcattgccttcctgaaggccggctgcggcccggtccacggcatgagcttcccctgggcggcacctatcacgtgccccacggcgagagcaactatatgctcttcggcgccatcatggactactatgacgagcacaagcccgacggtgagatcatgaagttcaaggagctggtgtccagcatcctgggctgcgaggtcaaggacgccatccccgagatgaacgccctgctgcagcgcatcctgcccctgcggcccctgcgggactgcggcttcactgaggcggacttcaaggccttccccctgtccgtcgaggccaaccagcagcgcctcatgaccaacgcctactaccccttcgacctggagtccgaagaggccatctaccgcaagtgctattaaaatttttccagacaacgaagggagagacggcggctgccgtctctccttttttcctttcgccacgcggtttctttcctctatacaccgcacctttctttgcatttttgtacagtacacacaaaaatataatgaaatcaaaaacattttatgggcgttctttttgagattgaggattgactttccgaaagagagccgctacaattggaaacaacatcaacgggttgtctgttttgaaaggagtggaacaccatggcattttacacgacgtcttcccagtccatgatgatgaatggtgcgtccgctcgccaggcggcgtctgcttcctgcgcctattccacggagatgtcccgtgcttccatgatgaatattgctctgattctggacgccattctgctggcgtccattattatttgcgccctgattccccttgccattctggtatccgtactggcagtggccctgtttgttctggtactggtattgttggcagcagagtatcatcatacgccgagatcgcgacgaggtgcataactgtttgatacagtaaagcggctccgcatctggcggggccgcttttttgtataatctgaaccaagaaaaggagattgcaagatgaaaaagaagttctttgccctcatgatggccatggttatggtcctcagcctggccgcctgcggcggctcggatgaagccgactccaactccggcgattctgccggcggggagagctccggcagcagcgccttcaaagtcggcgtcattggccccctgaccggcggcgccgccatctacggcacctgcgtggccaattccgcccagatcgcggtggacgaaatcaatgccctgggcggcgacatccagtttgagctgatgactgaggacgacgtcaacgacgctgagacctccgtcaacgcctacaacgccctgatggacgacggcatgcagatcctggtgggcaccgtcaccacccagccggccctttccgtggtcccgctgtcctatgaggaccgggtgttcaccctgaccccctccgcctccggcgacgatgtcatttccatcaacgacaatgataacgtgttccagatctgcttcaccgactccaaccagggctcccgttccgcccagtacatcgatgagaacttcgacagtccgaagatcgccatcatctacaaaaacgatgaccaatactccatcggtatccgggacaacttcaaggcagaggccgattcccgcggtatggacatcgtctatgagggcaccttcaccgaggccagccagaccgacttcaacgtccagctggctggtgcccagtccgccggcgccgatctgctgttcctgcccatctactatacccccgcctctgtcattctgacccaggccaacgccatgggctacgcccccaccttcttcggcgtggacggcatggacggcatcctgaccgccgagaacttcgatgcctctctggctgaaggcgtctacctgctgactcccttctccgccgactctgaggacgagatgacccagaacttcgtggcggagtatcaggaccggttcggcgagatccccaatcagttcggtgccgatgcgtatgacgccatctacaccctgtatcaagccatccaggccgccggcgccaccgccgacatgtccaatgaggagatctgcgatgctctgatcgaggtcatgcccaccctggccgtcaccggcctgaccagcgccggctccgagatgacctgggacgaaaacggtgctgtgtccaaggaccccaccgcagtcattatcgaaaacggtacctatgtcactccctgacagcggaacacacactccactgtaatagaggacagggatcggctgccggaactccggcagccctccctggacttctatggtggaaaccgacgcggggagctgtcaccgccccggtttctgccatagaaggggaaagagaggaaaatacttatggaatttctatcctacctgatcacgggcatcagtctgggaagcatctacgccatcatcgccctgggctacaccatggtatacggcattgccaagatgctgaatttcgcccacggcgacgttatcatggttggcgcctatgtgtccttttacgtgaccatgtttgcaggcagcaacctgctgggagaggatccctccgcactgaccaccggcgctgtggctctggtgtccgtgctgctggctatggtggtctgcacggttctgggcgtggtcatcgaggggctggcttaccgccccctgcgccaggccggcagcctggcggtgctgatcaccgccatcggcgtcagctacttcctgcagaacgcagcgcagctgctgttcggcgcgaatcccaagaacttcacccccgtggtcagcggccagctgacgctgtttgacggacagcttcggatctcctatgtggcgctgctgaccatcacggcctgcgtggtcatcatgctggggctgaccgccttcactggaaagagcaagatgggcaaggccatgcgggcctgctcggaggaccggggcgcagcccagctgatgggcatcaacgtcaacgccaccatctctatgacctttgccatcggttccgccctggcggccatcgccggggtattgctgtgctcttactctccggtgctccagcccaccaccggctccatgcccggcatcaaagccttcaccgctgcggtgttcggcggtatcggctccatccccggcgccttcctgggcggactgctgctgggcgtcattgaggccatggcgcaggcctatatctccacgcagttgtccaacacgatcctgttcgccgtgctgatcgtggtgctgctggtcaaaccgtccggcctgctgggcaagtatgtgcctgagaaagtgtgaggtggcggtatgaaaggctatttcaaaaacatgaaaaccatcaccaaggtggacttcgccacctatctgggcgtgatcctagcctttattgtggtgtcggtctgccaggcccagggactggtgaaccgttctctgggcggtatgctggttcccatctgctgctacgtgtgcatgtccatctccctgaacctgaccgtcggcattctgggagagctgtctctgggccatgccggcttcatgagcgtgggcgccttctccggcatcattgccgccatgagcctgcaatctgctgtcccaaatgatctggtgcggatgatcgtcgccctggtggtgggcgccttctttgccgccatcgtgggcttcatcgtcgggattccggtgctgcggctccggggggactacctggccattgtcaccctggccttcggcgagatcatcaaggatctgatcaactgccttctggtgggctgggatgagaacggcctgcacatcgccctgaacgtggacggcaccaagagcatgtcctctctcggcctcagcgaaaacggcatcgaaatcatcaagggcgcccagggcgccacgggcaacgcccgcatcgccacctttgctatgggctttgcactggtgatgattaccctggtggtggtgctgaatctggtccgcagccggaccggccgggctatcatggccatccgggacaaccggatcgccgccgagagcgtaggcatcaacgtcaccaagtacaagctgattgccttcgtcacctctgcctccctggcaggtgccgccggtgccctgttcggcctgaactactccaatgtcactgccgtacagttcgacttcaacacctccattctggtgctggtgtatgtggtgctgggcggtctgggcaacatctggggctccatcgtggcaacagttgtcctgtatgtgctgccggaggccctgcggcagttctctgactatcggatgctggtgtacgccattgtgctgattctggtgatgctggccaccaacaacccgcaggtgcggacgctgattagccggatcattcccagaagaaagggggcagccctcgatgagtaagaaatttgaaaagggcaagatggtccctgttcccagccatgccatcattccggagcgggacatcgacaaatcccccattctggagtgcagccacctgggcatcgacttcggcggcctgcgggcggtgaatgacttcaacctcaccatcggccggacggagatcgccggcctcatcggccccaacggcgccggcaaaaccaccatcttcaacctgctgaccaaggtctatcagcccacccggggcaccatcctgctggatggactggatacctccggcaagaccacagctcagatcaaccgcatgggcattgcccggaccttccagaacatccgcctgttcaacaacctctccgtggaggacaatgtgaagatcggtctccacaatcaggagcgctactccgccatcaccggcgttctgcgcctgccctggtactggagccgggaaaaggccgctcatgagcgggcactggaactgctgtccctcttcgggatggcggacttggcggaccatcaggccggttcccttccctacggcgcccagcgccggctggagattgtccgggccctggccaccaatccctctcttctattgctggatgagcccgccgcgggcatgaatccctctgagacggcggagctgatggagaatatcgtcaagatccgggacacgttccagatcgccgtcatgctgatcgagcacgacatgaagttggtcatgagcatctgcgagggcatctgcgtcctgaacttcgggcaggtcatcgccaagggcaccgccgaagagattcaatccaaccccgccgtcattgaggcatatctcggtaaacagaaggaggcgtgaccatggaaccgattctgaaagtcagcgacatcaacgtctactacggcgccatacacgccatcaagggcgtctctttcgaggtaaatcccggagaggtcgtcaccctgatcggcgccaacggcgccggcaaatccaccacgctgcagactgtctccggcctgctccactcccgcaccggctccatcgaatttctgggggagaacctgatgggcgtcccagcccacaaggtcgtggccaagggactcgcccaggtgccggaggggcggcgggtcttcctgcagatgaccgtagaggagaatctggaaatgggcgcctatacccggtccggcggcgacatcgacgcggatctggaaaaggtctacgcctatttcccccggctgatggagcggcggcggcagatcgctggcaccctctccggcggcgaacagcagatgctggccatgggccgggcgctgatgagccgtcccaagctgctgatgctggatgagccctccatgggcctggcacccattctggttgagcagatcttcaagatcatccaaaccctccatgaggcgggcaccaccattctgctggtggagcagaatgcccaggcagccctgagtatcgccgaccgtggctatgtgctggagaccggaaaaatcgtcacctccggcaccggaacggagctgttggcctccccggaaatcaaaaaagcctatctgggcggctgaagtctcagaaaaaggagagcgtgtgctctccttttttctttgcaatctgccgggcatgtggtatactgctgtcatgacggaaaggagggatcccatgcgcgcggaagaacggcggcaggccattcgggagcttctgcagcgggcaaagcagcctgtcagcgcaacggccctggcggctcaattctccgtcagccgacagatcatcgtgggggatattgccctgctgcgggcggctggagcagacatctccgctacgccccggggctacgtgatcctgcgagagacgggaggtctggtgcggcaggtggccgtccagcacgatgccgctggtatgggagaggagctaaacgctatggtggaccagggctgcacggtactggatgtcattgtggaccaccccatttacgggcagctgaccggccctctgcagctctccaaccgctatgatgtggggcagttcctctcccgctgtgcgcagtccgacgcccgcccgctgtcggaactgacggaggggatccatctccacactctctcctgtccggatgaggcggcattcggccgggtgtgccgggagctgcggcggctgggcgtcttgctggaaggttgaacatgtaaaaaagcagttgacaggaaccgggattttgtgtatgatacggtttgcaggtgtcaagacacctgtaaaccgtattttttgattctacataaagcaggtgtctcccatggaacaggtcaaaggctttctgaagcgcaaaaacattgtgatctccgccaagcggtacggcattgacgccctgggcgccatggctcagggactcttctgttccctgctgatcggcacgatcctcaacaccatcggcacccagttccacattggctttctcaccgcccaggtcatcaccatcaatggcgtggggtataccatcggtggactggcgtcgttcatgagcgggtccgctatggcggtggccatcggctacgctctccaggcgccgcctatggtgctgttctccctggtgacggtgggctatgcctgcaacgccctgggcggggcgggcggaccgctggccgtgctgttcgtggctatcatcgccgctgaggtgggcaaggccatcagcaaggagacgaaggtggacatcctggtgacgcccatcgtcaccatccttgtgggcgtgggagcggcctggatcattgcgccccccatcggcggagcagccagcgcctttggccagctgattatgcggaccacggagctgcagcccttcttcatgggcgttctggtgtccgtgctggtgggcatcgccctgacgctgcccatctcctccgccgccatctgctccgtgctgggactgaccggactggcaggcggcgccgccgtagcgggctgctgcgccaacatggtggggttcgccgtcctctccttccgggaaaaccgctggggcggactggtgagccagggcatcggcacctccatgctgcagatgcccaacatcgtgaagaacccccgcatctggctccctgccatcctcacctccgctgtcaccggacccctggccacctgctttttcaagctggagatgaacggagaccccatcaactccggcatgggcacctgcggcctgtgcggccagctgggggtctggaccggctgggtcaatcccagtgacgcggctctggccaatggggccgccgccatggcccccaccgcctttgactgggtgggactgatcctgatctccttcgtcctccccgctgtcctcacctgggccttcgggctgttcttccggaagatcggctggatcaagccgggggatctgaccctgccgcagtaggtaaaatgcccggaccgcgatgcggtccgggtaattttatttgttcaggccaaggaacacgagacagccagtcaagaaccacgggctgtatcgcataagtgtatagtagttcatatttttgatccaatcaacaaacccaggaatatttgctaaaaaatgaatctatgcccaaaacaataaatcacaaatattagataatacccaatggcaacagcgccaaatatcaaagccatcatccgaagccgcttggatggcaggcggaggtcgacaaccaatgccgtaccggacatcaaaaggcctccagccgccagagcagcagctgacggcacagtcaaagcgtaccatacccacggcataaggtcatatgtttcccagcaaatctgctgcacaaagggccttaatactgtttccagcacgcagaatatgaataacaccgctacacagatggctgccaaagctgcatacttccgttgaccgcgtcgataactttcctctcgccccgggccgtagatcagctcccggacgtcggcgttcagcgcctccgccaaggtggtcagggtctcgatatccggctgggtctttccggtctcccaggaggacaccgcctgccgggtcacatggagccgctccgccagggcgtcctgggtcagcttctcccgctggcgcagctgcttcagattttttcccaccgcgttcacaacctcgcctcctgctgccagcgtaccacagtcccggcgctttgtcacgcaacaaagtgttgcgcgccctgcaagggcttgcggcggaccgcgggatatggtatcgttaggatatccgagatcaaaaacaggaggaactgtcatggaataccggaaatttggggacgcctacatcgtccgcctggaccgggacgaggagatcctggcccagctgaagatcttcgcagaaaaggaacaggtcaaactggcctctgtcaccggcctggggctgtgaaggacttcaccgtaggagtgttcgactccagcgccaaggcttacaagtccaaccgcttccagggggtctatgagatcgtctctctggtggggaccatcaacacgatgaacgacgcgttttactgccatctccacatgtgcgccgccgaccaggagggccacgctttcggcgggcatctgaacgaggccgtcatcagcgccacctgcgagctagtggtcacctgcctgcccggagagacgaaccgggtattcagcgacgaggtgggactgaatctgatctccttctgaaatccgcggaaaagaggctgaggagtattcctcagcctcttttccgcttttgggggacgctgtcctcacccgaaggcccctgccgcgtggtcccgcagaggcagctcctggaaaatggatgcctccaccgcctcgtactcccccggcgtccgaaggcggcgcattttcttgtcatggcgttcgccgccctcgaacaggtggatcaggaagaaccagacctccttcatccgctgggccgccgggcccacctggccatagaagtcctggtaggactgatacagcgtccgggtgaaggtctggagctcctgccgggtggtggggacgccgccccggagcttccgcagcagggccgggtccgcgatggcccctcggccgatcatcaccgcgtcgatggcaggaaagtccaccgcaaagactgtgcagtcctccacggtcaccagatccccgttgtagcacaggggattccggctgcgctccgccgcccaggcgaaccagtcccggtgcacggtccccttgtagaactgcttctgcacccgggggtggatggtgaggcaggcgatgggataacggttgtaaatgtccagcagccgctcgaactcctccggctccttcacccccagccgggtcttgatggacaccggcagcttcacggcggcgaatacctcgtcaaagaaccgctccagctcctccggctttgccagaaagcccgcacccttgcccttggcggtgacggtgccagagggacagcccaggttcagattcacctccgtatagcccatgtctgccacgatctccgccgcccacagaaagtccggtgcccggcaggtcatcacctggggcaccacaggaagccctgcgttggccgccgggtccagctcccgttgatcccgcttggtcaggatatgctgatccgtaggggagaaaaacgggatgaaataccggtccgccccgccgaacatccggtggtacacctgccggaacaccaccttggtgataccatccagcggggcgaagtcgtaccgctggatcatcccagtgccgtctcccactccgcctggcggaagccggtgcggacgaagtcctcccccaccagaatgggccgctttaccagcatcccgtcggtggccagcagggccagctgctcctcctcgctcatctccggcagcttgtccttcaggcccagagccttgtactggaggccgctggtgttgaagaacttcttcaggggcattccgctcttctcccaccagccccgcagctcctccgccgtaggattttccagcttaatatcccgggcctcgtaagagacgccccgctcgtccagaaaggctttcgccttctggcaggtggtgcacttggggtaccacaaaaacaacatgatgctctctccttcttttgatctgtctgctcagtagctgctgatctccaggctctcgtcgtcccggcccttctcgatggcccggatctccacccagtatttcacctccggactcacctccacctggatccggtctcccacctgacggcccagcagagcctttcccacaggggactccttgctgatgaggccctttaaggcatcctgccgcaaggtggtgacgatctgcagcgtcatctcctgcttcgccagctcgttgtagatcgtgaccttgtcgaacaatcccgctcggtcaccctggtccttcacctcgatgaccttggcagtgcggatcatccgctccaggtagcggatgcggctgtcgttgcggttcttggcctgcttggcgcacttgtactcgtagttctcgctgaggtcgccgaaggcccgggccgtctgcacctcctcgatcagctgaggacgcaggacccgggtccggtagttgatctcctcctgcatctttttgatgtccacttccgtcagttcgtcgtacatgacacagctccttttcaggctggggtcgcggtccgggtccgtttgctttgcaggtctctcacaggtgtggggaacccggcgcaggtgaaatgcgaaatcgccgctctgcggctattctaccacgtccggcaggaaagcacaaccccggcggctccctgccccggcaccctttcctccgccgggaatagaatgaagtgtatcacgagtcgaggaggcaattgaaatggaaagcacttccagcgcagtcaccatgtgcgccaccgtcctgcgggtctgcccctgcgaactgtgcgtctgcgaccacgagaactgccagcaggtcctggtccatacagacaacgcctgctgcttccgggtgggccagcaggtctgcatcgagttcagcggcgccatgacccggagctgtccgccccagatcaccgccgactgtgtccggccggtgaactgctgctgttgaacatttgaaaaagccgcccgggggcgaatccccgggcggcttcggcttatgggttgcattggccgcagggcgtatagccctgggcgatcagatcctcccggctgccggtatactcctgccggttggcggtgctcatgccggacacgctggaacagtccgggtcgtgaaatttgtggctgttggtattgaggatgtacgtggtctcgccgctttgcggctccgctccctcctgccagctctcgccggtggcgtagtcgatggtgatgccgggctggacgttgtacacatagacattgaagcagacgccttccccctcgtcctccacagaccaagcctccatctggacaccgctggctaccaggttctgaccctcgaacaccggggtcacccggtagaggacgtggttgtccgtctcctttacatagtccgccaccagattttcaaagggcagcatcccgtccacattcatatagcgggtgccggtgatgagattttcctcgttggcgttctctccggtgagctgaaagccgatcaggtgacagcggttgtacaggtactccccgtcgtactcccggttgatccagccggagggtgtgacggaactgatgctctcccggtcctctgtgggcatcagatcctgtcccacgttggcataggctacgccgcaacggcccagagtgtccaactcactgtacgtctcaaaggacacagaggtcatgtcctcctccggaaaatccggctggttgccatcgacggccacgtagggctccccggaccaggcgggaatatcctccagagaaaaggaggtgacggtgccctccgccgggggcatcatgcagccggagaggagcaggcacaaggacagcagcgccgccgtcagggaaatgcgggttcgattcatgggatatagacttcctttgtaatgatctcgtgggagaagccggggaactcctcccgccgggccagagtccagccctccagggacaggtcccagtaaaggtccgccggataggcccggtcccagcggtacagcaccacccgctccacacgcccggcaaagggcgccacagagcggtcctccacaaagcagggctcccctggccccgccttttccaaaaacgactcgtccacacaaaggcggctctgctcctccgccgggaactggcgagccgtggccccactcacccagaggcaggcctccccgacctctgccagcaggtccgcccgcaccgcccggtcccggctctgccggcggcagttgaaggccatgccgttccggccgtccacacaggccatcaggatcatgctgcatcctcccttcgcgctctttctctacgatacccaaattccgctcgaaacgcaaggaaaatttttcggcttccgccgggggaagccgccgtaccgggcggaagcccctcccgcctgggaggggcttccctttggaagatatccttacgccttgtccggacgcttgtactccacatggagcagctgatgggtgcggcccttcatcgctccctccaggagctttgtaacgatggggttccgctcagaccgcttgatgagggcggtgcggtccgcctcatagaggccctctgcccgctgctgcttcaccgggatcagcccgtagggctggccagcgccgcctacgcagccggtcttgcaggtcatgacttccaccaggtcgaagtactcctgaccgctctcgatatcgtccagcagcttctgtgcgttcaccaggccgtggaccaccgcgatccgcagcgcccggtcccccaccggcagcgtcaccgcccggatggtctcgctgccccggatgccggagaactggatggcctgcagggtgttcttggacttgtcctccactacccgccgggccacggcctccgccacgccgccggtggtgccgaagatggtagccgccccggtgcccatgccgaagggcaggtccggggactccccctccagctctgcgaaacggatgccggactccttgatcatcatgatgatctcctgcgtagtcagcaccagatccacatccggttttccgtcatgctggaactccggccgcttggcctccattttcttggcggtacagggcatgatggcgatgtggtaggtggtgcggccgtcctcttcgtccttcctggcgtactgatccttcagcaccgccgcgaacatctccatgggagacttgcaggtggagatgttcttcaggaagtggggccgctcctcctccacatacttcacccatgccgggcagcagctggtgaacatggggaaggggccgccttttttcagccgctccaggaactcgtccgcctcctccatgacggtcaggtctgcgccaaaggtggtgtcgtacacctcgtcggcgcccatcatcttcagggcggacaccagcttgttgatggcattgacgccgggctccaggccgaaggcctcgcccaccgccacccggaccgccggggcgatctggaacaccacccgcttcttcgggtcgtggagggcccgccacccccggccgatctcgttaaagatggtgatggcgccggtggggcaggcggctgcgcactggccgcagctgatgcagttggtctctccgagcttgcggtcaaaggccgggcacaccaccaggtcgctgccccggtgggcgaagttcaggatacccatgccctgcatctcctcgcacacccggatgcagtcgccgcagaggatgcacttgttgggatcccggacgatggccggagaggaggtgtcgatctcatagtggggccgggtgtccttgaagcggacgtgccgcacgccgaagcgcagggccagctcctgcaggcggcagctgccattcttttcgcaggtggtgcagtcccggcagtgagaggacagcatcagctccaggatcatccgccggtgctttaagagccgggcggtattggtgcggatcaccatgccatcccggggctccatggagcaggaggcgtcgatcttgccccgctcgtcctccaccacgcacatccggcaggcgccgtaaacagacagttccgaataatagcagaaggtgggcatatcgatgccggccttccggatcacagccaggacgtttttctccccgtcgaagggcacccgctggccgtcaatgtacataattccctttgccatggtactcccctcctcacttactggccgcgatggcgccgaagggacaattggtcacacaggcgccgcagttgatgcacttctccggatcgatgacgtggacctgcttggccgcgccggtgatggcctccatggggcagttcttccggcacttgccgcagcccttgcatttctccgggtcgatggtggggtggggtttttccttgttgcagatgggacagtggtggtccactacatgggccagatattcatcccggaaatacttcagcgtgctctggacgggcttgcaggcgctctgccccaggccgcacagggctgtcttactgatggtgtccgccagctcctccagcaggtccagatcctccagtgtgcccttgttgtcgatgatccggtccaggatctccagcatccgcttggtgccctcccggcaggggacgcacttgccgcaggactccttctgtgtaaactccatgaagaaccgggccgtctccaccatgcaggtgtcctcgtccatgaccaccaagccgccggagccgatcatggcgccgatgctcttcagactgtcgaagtccaggggcaggtccaggtgctcgcggctggcggtggtggcgccgccggaggggccgccgatctgaacggccttgaacttcttgccgccccggatgccgccgccgatgtcaaacaccacctcccggatagtggttcccatgggtacctcaatgaggccggtattcaccacgttgcctgtcagcgcgaaggccttggtgccggggctggtcttggtgccgatggagcggtaccagtccacgcccttgcggatgatgaggggcacgttggcaaaagtctccacattgttcagcaccgtgggctcggcccagagaccgtgctcgatggtccggggcggcttgacccgaggcatgccccggttgccctcgatggaagctgtcagggcactgccctcgccgcagacgaaggcgccggcgcccatgtttacatggatccggaaggagaagtctgtgcccatgacgtgatcgcccagaagaccgtactcctccgccttggcgatggccgctttcagccggctcacggccagcggatactccgcccggacataaatatacccctcgtcgctgcccacggcgcggccggcgatcatcatgccctccagcacgctgtgggggttaccctccataatggagcggtccatgaacgcaccgggatcgccctcgtcgccgttgcagacgatgtattttttctctgacttctgtttccgggcaccgtcccacttctggcccgcggggaagcctccacctccgcggccccggaggccggagtcgatgatggaccggcagatctcctcatccgtcatctcaaagagggccttttcaaaaccggcgtaaccgcccttggcgatgtactcctcaatgtcctcggcatcgctgctgccgcagttctccagcaccacccgatgctgcttcttgtagaaggggatgtcctcctgccgggggtaggctacgccgtccaggtgatacaccagccggtcgatgatctcgccgcccagcacggtcttctccagaatctcatggcagtcctccggcttcacatggatgtacatgacgcccataggctcgatgtggaccagaggccccatctcgcagaagccgtggcagccgctcatctttacatggaggctcttctccgcgtccgtgtcgtgtttgaggcccacgtagaccggcagaccccgtttttcacactccgtcttcaaattgtcatagatcttcatggcgccgccggcgatgcagccggtgccggcgcagatcaggatagagggcacctgctcgctctgcttcagggcgttgcgggcgttagcctggaacacgtggaagctgtcccgcgtcatctttacctgtctcatgcggtggccgcctcctttctgcggatatcctccaccagcgccagcgcatcttccggcgtcatcttggcgtggacctctccgtcaatggtcatgaccggtgccagtccgcaagcgcccaagcaggccacggtctccagggtaaacaggccgtccgcggaggtcttccgctttccggtcagacccaaagcgtcccgcaggctgtcataaatgggtccggatttgcgcacgtggcaggccgtgccggtgcataccttgatgatgtgccggcccttggcctccaacgagaaattctcatagaaagtggccacgctgtacacctttgccgtgctgatgcccagcttttccgcgatcagggtcagcgctccctcgctcaggtacttatactccccttggatctcctgcatgatcgcgatcaggttcgactgatcgcagccgtaggcgtcgatgatcgcctccgcccggtccagattctgctccataaattctcccctcattgattcggatgataaaaaacacgcgggatccgcacttgccggcggatcccgcgcttgtgtgctctgtttccgatatgtgcttatgcgtctgtatcagaatacgccctgctccatcatggcctcagccacccgcttgaagccggcgatgttggcgcctgccaccaggttgtagcccaagccgtactccgcggccgcgtccacgctcatctggtagatggtgttcatgatccggtgcagctgcgcgtccacctcttccgccgtccacaccagccgctcactgttctgcgccatctccagtgcgctggtggccacgccgcctgcgttcaccgccttgctgggcgccacgatcatcccgggctgctccatcaagaaccgcagcgcgtcgttggtggtgggcatgttcgccacctcaatgtagtacttcacgccgttggccgcgatctgcttcgcctgctccatgtgcacgtcgttctgcatggccgagggcatcaccacatccgccttcacgccccagggcttctcaccggggaagaattccacgccgaacttctccgcatagtcctgtacccggttgcggccgctggagcgcatctccaccagatacgcgatcttctcctccgtggctacgccgtccggatcatagatatatccgtccgggccggacaatgtcaccaccttggcccccagctgcgtggccttcttacagatgccccaggtcacgttgccgaagcccgcgcaggcgatggtcttgcccgcgatccgctctccctcgtgctccagcacgttctggagatagtataccgcgccgtagcccgtggcctccggccggatcaggctgccgccgtaagagaaccccttgcccgtcagcacaccgttctcccaggcccccttcagccgccggtactcgccgaagagatacccgatctcccggccgcccacgcccatgtccccggcgggcacgtccacatccggcccgatgtaccggtacagcgcctgcatgtacgcctggcagaaccgcatgatctccgcgtccgacttccccgccgggtcgaagtccgcgccgcccttgccgccgccgatgggcaggcccgtcagggagttcttgaagatctgctcaaagcccaggaatttgatgatgccgggatacacgttggcctggaaccgcaggccgcccttgtagggccccagcgcgccgttgaactggcaccggtagccgatgttcgtgtgccactggccccggtcatcctcccaggacacccggaaggtgaacatccgctccggctccaccatccggttcagcaggtccaccttctcatactccgggtgcttctcaatcaccggctccagagaggagaacacctcctccaccgtctgcacgaattccggctcgttgctgtgcttcttcttcacgttctcgatcacgctggtgagatatgcgttcatggctttttcctccaatcaaaattttgaaagccgtgggcacacaggcccgttcatatcaccagacaggaacggaaatacctctccgctcccgcgtctgtcctcataccacctctaacagccgttcacgttccgctgcgtttttttctccccctctccgccggccctctgccggcctccgcagcaatctcgctttcgctgtatccggcggacggcatctttcgatggccgttccgccccatgcgatctttccagtttgattgtagcaaaaaaacatattcttgggaagccctattgtgtaaaaagtacatttttctttattcactcattagtattttacaatattttccataaacgtttcctgtataaaccagaactatctgtagccagccgtggcggaaaataccacatctctcttcccgggtgcccgaggcagcggcaacgaagcggaaaaccaaaaagcctgtggtacaataacttccagatctttacctgtaaaagggctgtaattcagtcctccgcggttgaaagccttgtgccgtcatattcatcgcagtatcagccgcctggggcgatccgcttcaggttgcggctatgcactgccgcccaggtgagcggcggtcagagagctcagggcgtcacagcgaactcacagcatcgctaatcagtgtcaatattgtgggtaataaagcgggccctgaaattgcgctggttgcacatcgcccccaccatgctgccgagcggctgtcagggccagcgtaatcttcagggaaccgccgcagccgatgtgatccatattggccacctttgtaggacgatcttcttctggaggaacgtcccctcggcattctatatgtcgggagcccgttccatgacattccttccgggagcgtaggctaatcgacctgataaaaggaaatgccgcataccagcctcaacaggccgatatgcagcataaaatcggacgaaacacctggttcggtatctccggatgctgaaaacacagcggagtaaggctgaccttccgcaggagcggctttatgtgcggcagcgtgggtacagtttccttgttctttcattgcgcacagcgcgaaaagcattcataggcgcccaaaacagatgtcttaaaattcagcaaacacgctgagagagcaaagaaaacctcggaaccattgcagttccgaggttttctcatctggcagcgggtgaaggattcgaaccctcacatacagagtcagagtctgctgtgctacccttacacaaacccgctatgaagttgtgttcactccgcagcgaacagatattattatacagaaaagcgtgattttgtcaacccccttttttatttttttccacatgttttttcaagcgggcgcggaatcccgatcccgcgcccgccactatgtaagaccgttcactggccccgcaggccgtccagaaagccccggaggaatccgccgccccgtcgcctgctcccatctttctccatacggtccgctgcctcctgggcgcccgcatacccttgcttcgctgcggcctgatagagttctctcgcctgcctcagatcccggggcacgcctttgccgtgctcatagcaccaggccagattatactgggcacggggctcggactcctccactgcctggcggtaccacttcaccgcatctgcccagctctgggccacgccgacaccggtctcgtacagatatcccaggttgcaggcggccacccggtcgccgccctctgcagcctgccggtacaaatcggctgccttggccgggtccttcgccacgccgtggccgaactcccagcagacgcccaggttgcactgggcacgggggtagccctgctccgccgccgcctgataccagcggacagcctcttgccagttctgttctacaccctctccggtctcatacagatatcccaggttgcactgggcggccgcgtcctcccgctccgccgcctgtcggtacagccgggctgcctccgcggcatcccgctccacgccttcgccccgctcgtagcacacgcccaggttgcacatggccgccgcggaaccggcatccaccgccctgcgataccagtggaccgcctcttcccagttctgttccacgccgcggccgtatttgcagcagatgcccatgcagaacatcccccgggggtcctcctggtccgccgcctgtcggtaccagtggacagcccgcttccagttctgctccacgcccttgccgtactcatagcaccaggccaggttgcactgggcacggggcatcccctgctccgcagcagcgcggtaccaccgcaccgcctcctcccagctctgctccacgccctcgccgctctcatacaggaatcccagattgcactgcccggcggcattgcccgcctcggctgcctggcgatacaggctcacagccctgctcaggtcccgctccacgccctcaccgcgttcatagcacacgcccaggtcgcacatggccgccgcggagcccgcgtccgccgctttttgataccaggccactgcctccgtgctgttctgcgtcacaccgcggccatagtcaaagcagcgggccacgcagaaaagtcctctggcatccccctgctcggccgctttccggtacagacggtagctctctcccaaatcctgggggacgcccttgccgtattcatagcaccatgccagattgcactgggcacggggcaggccctgttccgcggcggcacggtaccaccgcaccgcctcctcccagctctgctccactcccaggccgcgggaatatgcctcccccagcaggaactgggccctgggaaagccgttttccgccccctttcggaagcactccaccgctttggaatcatcccgcgccacaccgatgccatgggcatagcagtatcccaggttcgtcagggcgggcatatagtcccgggcggcggcctgggcgtacagcaccaccgcctgccgggggtctgcaggcacgccgatccccgcctccaggcaccaccccaggttcgtcacacccagcatatcatccagggccgccgcctgttggtagcaggccagcgcgtccgtcggccgctcctcatccacggcccggttgcccagctgcacccagtcgggccccgtcagctcctcttcgtccacagagaggaaaaaggtgcccccgcactgggggcagacatccggttcctcctctgccagaaacccgcagtccgggttctcacagcgatagtaattcatctgcgcacctcctctgtatcaaagcgccgcttcatcctccgcagaggaggcgccccgcaggttgtaggcctccggaaacgcgaacgccctgccccggaatttgaagcccgggaacgtgtccagctggacgccgtgaatggcccggaacatgctcttctcaatattgggattggtctttttcagctcccgcagcaggagcttcatctcctgccgcttgctctcgcccacaccgtcggccgcaccgtcccgctcctctgtgaagcggcaggcgcactggagaaaccgcaacccattgtagttcttccaggcaatgatggcgtcctcatggacacaatacagcggacggatcaattccatgcctgggaaatttctgctgcggagcttggggggcatggtctggagctgggcaccgtaaaacaggcccagcagcgtggtctccagcacgtcggagagatggtgccccagggcgatcttgttgcagcccagctcctgagccttgctgtacagaaagccccggcgcatccgggcgcataagtagcaggggttcttctccacctgataggcaacgtcgaaaatatcgctccggaacacggtgatggggatgcccaggcgggcagcgttctcctcgatcagcgcccggttggccggggcgtagcccggatccatcaccagaaaaaccagctcaaagggctgttctgtgtggcgctggagctcctgcatcagcttggccagcaccatggagtcctttcccccggagatacagacggcgatccggtctccgggagcgatcagctcatacctcttgacggcggcaatgaaggggttccagagctccttgcggtattttttgatgaggctgcgctccgcagcctcctgtggtgtcaattcgcgggacatggggacctcctaaagcaaaatgggagcggccgcgtcagaaccagatagccaccagccgcagcagagaggcgcacattttgcgcagccaagaccgctgattccactccgccagcgtatagggcgcgctctgggccaccatccggtccatatcctccagcaggtcttccaccgcgggcatgtgatagaggagcacggcgcattcgtagtgcagctggaacgtccggtagtccatgttggtgctgcccaccagggccacctcccggtctaccatgacgctcttggcgtggacgaagccgggggtatagcggtaaatcttgacgccgtgggccagcagctcaccccagtaggtctccgccaccatgtagacatatttcttatccgggatggcgggtaccaccagccgcacgtccacccctgcgtcggctgcgatgcacagggccttctgcatggactcctccaccgcgtaatagggcgtggtgatatacagcatcttctgggcggaggcgatcagctggaggtaggtgtcctcgatgggattgtccggattgttcagcggaccgtccgtgaagggctggcaccagccggtgccctcgatctccacccggggacggtagtagtcgtcctcattgggcagggagcggccgatcatcttccacatctgaatgaactgggaggcaaagccccaggccccggcaccgtcgatccggacgccggtatccttccagtggccgaaccggacaaagaggttggcgtattcatcggcaatattgatgcctccggtgtaggcgtgcaccccgtcaatgacggcgatcttccggtggtcccggtagttgaagtaaatccgattcacgtagcggtggactggattgaagacctccacctccacgccagcgtcctgcagggcctggagggaggcgtcggaaaagcgggtgaggttgccgaagtcgtcgaagatgatccgcacctccacaccggcggcggcccgctcccgcagcacatggaagatccggtcccagatctggccctccgccaggatgtaatactccaggaagatgtagatctccgctctctggaggtggagcaccaggtcatcgaagaaatcggctccctccgcgaaataccgggcctgtgagccgccgtacagcaggaagtcccgcgactgcaaataggaggccagccgtccccaggccggggagcggcggctcaggtgggccacattggcggcgctggcctggcgggcgctctcccgctccaccggaggggcgaccttccgcagactcaggcttttggcctgatggctcccgccccacagaaggaaaagaatcataccggccaccggcagggccagcagcaggcacatccacaccagcttataggaggggctgccggggcgcagatacacccagatcgccaccactgcgccagccagctccagaatgaaatagacgtagctgatcttttccgccagcaactgggtcagcgccagcgtcagcacgatctgggcaatcaccgtcagtgcgcagatggacaggctggcggcggcggagatccgccgttccgtccgctcttccggctggggcagacttctttttcgcatggtgcggtccacctccttctctctcagcttcgaccgcttatcttattattataccgaaatacccagtactccgcaaccaatattctgtgaacaaacagccccgccggagggcggggctgttgggtcatctgctccggcagagcagatcctgcttgatgtcgaacagcttctgactcagatccacatagtaggtgtgagggttctcgaaccgcttcaccgtgtcccacagggtatccacctgggcacggcagtaggcctggatctccggcagggcgggcagctgatagaccagctctcctccctgaaagaccgggacctgaaggggctttgcggtaaagttcgtataggtcttgcgcttccaggtggccctgggatcgaagagctccagtggggcgctctcgtccaccgtctcgtcccagacggtgatgtagtccgcctccgccttgccggtggcgttgtcaaagatccgataggtcttcttgaagtggggaatggtgatcttgtccaggttttcgctgaccttgatcttggggatgatcttcccgtctccatcttccacagccgccagcttgtacacaccgccgaacaccggctcgctgcgggcagtgatcatccgctcacccacaccgaacacatcgatcttggcgccctgcagcagcaggtcctgaataatatactcgtccagggagttggaggcggagatctggcactcggtccagccggcggcgtccagcttgcggcgggcctcctgggtcagataggccatgtcgccggagtccagacggatgccgcacttgcggatgcccaggggcttcagcacctcatcaaaggcccggatggcatccggcacgccggacttgagcacattgtaggtatccaccaacagcgtggcattgtggggatagatctggcagtaggtcttgaatgcctcatactggctgtcgaacatctggacccaggaatgggccatggtgccgccggcaggtacgccgtacagctggtcggagatcgtgcaggcggtgcctgcgcagccgccgatataagccgcccgggctccggagatggcgccgtccgtgccctgggcccggcgggagccgaactccagcaccgttcgcccctgggccgcccggacgatccggttggccttggtggcgatcaggctctggtggttgatggtcagcagggtgaaggtctcgatcagctgggcctggatggccggcgcccggaccgtcaccaccggctcccgggggaagataggcgtcccctccggcaccgcccagatgtcgcctgtgaaacggaagtcccgcaggtagctcaagaaatcctcggagaacaggtgcttgtcccgcaggaaggcgatgtcctcctcgtcgaagtgcaggttctgaatatactggaccaactgttccagacccgcgcagaccgcgaacccgccgttgtccggcacgttgcggaaaaacacatcgaaataggtgatccgatcctggagccctgcccggaaatagccgttgcccatagtcagctcataaaaatcgcagagcatcgtcagattgagtttctcttccgttttcataaccgtttcccctgtgccgccggcacagatccttccatgaagtttcaggcccccacaccgctggaggcggtctgtccggggttgttattcccttgaattataagcggttcccccaggaaaagcaatgctttttccgaatttgttgtcaatcttttatcaatcgtcttgacaacaactccgccctcccctatgatggggaaagattgaaccgcacattttccggtacacagcggactggagggttttctcgtgaaaaagtttgctctcttcttctccgcggcggccgttctgtgcatcctgaccggcctcactgcataccaccgctcatttcctctggacgcggacctcaatgggctggaaccggctgcgctccaatggttcaaccggggcaggtccgttccctgcgaggcggaccagttggagctgtaccagcctgtgaccgtggggcgtctcacctattatcctctggttctggatggacggttgggatacctgtgtctctcgagaggattcaccgggcggtataaattcgaccactccggtcgcgggaccggctccttccgcaacggagtggtggagtccgacggggagcagatgctgctcttcgaggggcggaacggcgacggccgcatcgcccgggcggtcttttcactggagggcggtgggccttatgcgctggacattccggcctctcccgtctttctggtgagcacctcagtggatgataccgtctccacaggtcctatcagcatagaggagattgtcttttatgacagccaggggcgggatatcaccaagtcgtttgacctcagcggaggcgccatccagtaagcgcccccaccgaaaaccaagcggccgtctgccgctgaaaggaagtcatcacaatggatgtgatcttaggcattgacatcggcggctccaccaccaaaatcgtgggtctgcggacggacggcagtgtgatctccatgctgcgggtccgggcggaggatcaggtgaccagcctgtatggcgcccttggcaactatctcaccagcaaccggctctccctgcgggatgtgcggcgggtagtgctcaccggcgtgggcgcctcttatgtggagggcgacatctacggtctgcccacctgtaaagtgggcgagttctccgccagcggcaccggagccctggccctgtcgggccagtcctccgccgtggtggtcagcatgggcaccggcaccgctttcctctgggcgtcccccgacggcatccgccacctgtgcggcagcggcatcggcggcggcactctgggcgggctctgccacaagctggtgggaatggagcgcttcggccagatcaaaaagctggcggagagcggcaatctggaccatgtagacctgaccatgaaggacatcacggtccactccgctcccactctggacccggatatgactgccgccaacttcggcgatctggcggaggacgccactcctgcggacctggcggccggcgtggtcaatctggtgctccaggccatcggcaccatgacggtgctggcctgccagtgctgtgactccaagactgtggtgctgaccgggtccatgaccaccctgccccaggcggtcacgaatttccagctgtttgaaaagctgtacggcatccactatatcattcccgaaaacgccacgtttgccaccgccatcggcgcgggactgtacagcctgcagaaaaagccggaggcctgattgtgccatgacggaaaattggtccctgtatcatccggagatcccggaatttctccgccgtctggcagagacgccgcccatggcccggctgcggcaggtgggcatgaactgcgggtgcgagtacacgtccttcccccactttgccgggtgggccccctactcccggtttgaccacagcgtgggcgtggggctgatcgtgtggcacttcaccggcgatctccgccaaagcgcggcgggactgctccacgatgcggccacacccgcctttgcccatgtggtggattttctccacggggaccacctgcatcaggagtccaccgaggcacggacggcggaactcatcgagacctcgccggagcttcaggcgctgctgaaagaatacggcctcaccacggaagacgtggcggattaccaccgctatcccatcgcggacaatgactcccctcagctctccgccgaccgtctggagtacacgctgggggacctgcggtgctacggcttcgccggggcggacgccctccgtgtattctacgaagatctcaccgtctggcgggacgagtccggccggccggagctggccttccgcacgcgggagaccgcctgcgccttcacagaggcatcgctccagaccgcccaggtctatgtggcggacgaggaccgcttcgccatgcaggccctggcggacctgctgcgcgatgccgtgaaccggcaggtcttgacagaggatgacctgtatcggacggagtcttttgtcatccaaaagctggaggcagatccggccagcgcccgccggtggcgccggttccggcgcttctgccgggtggagcggagcgcggaaaggccggagaacggactctggttccggattcccgccaagctgcggtacattgatccgctggtggcaggccttggccgcgtctctcgcttggacgccggggtgcggcaggcccaggaggccttcctggccacggactttgcctgctggatcggtgttccggaggaaaccgccggagagaatgattgaaagattgggagaaagagacatggattacagagaaaaagccgtccggtgtgtgcgggagaccgtcctgcctgtccaggcggcgcagttccgggcgtgcggctgcgacctggacgcccagtaccgaaaatacggggacacggagagcttttttgccaaggttctccagcccgggcgcctctatgaggtgggttatcccaaatgcgtctgccctgaggtgctgggggagagacggccgacgccgcccactgcgaatgttcccggcagagtgtgctgtatattctggaacagctgctgcccgaaagacacatcacggtccggaccgtggagacggtgctgggcggcgggacctgctgccggttcgccgttacagtggagtagcagcggaaaatgcaaacaggagcccggtgctgtgcaccgggctcctgcgctcacatatagggattattcctcgtcctggggcttgtcctcgtcctccaggccgttcagatcgaactccagcttctcgccgcagttggggcagatgacctcgccgtcctccaagacggactcgtcgaagtagatggtctcctcgcaggtggggcaggtggtggcgtagcagtcctcgtcctcctccggctcctcatactcgtatacatcctcttcgtcctcgtcatcctcgccgaagacggcgtcctccacatcctccaggtcatcgctgacagcgtccaggccgtcgtacagctcctcctggtccgccttcatatccgcgatctccagggcgatgtcgtccagcacgtcgatgatggcggcaagcagcttgccctccttcttctcggtgtccagttccatgccttcagccaggcccttcagatacgcgaccttctccgtaatctccataacagcagctcctttcctttacaaacagcgttgcagtcattctcaggaacaaaagggggaatacgcttcccccctttgcctcacttactccttgctgcggccgatatactcgccggtgcgggtgtcgatctggatcttgtcgcccgtgttgatgaacagaggcaccttcacctcagcaccggtctccagcgtcgcgggcttggtcacgttggtggcggtgtcgccccgcaggccgggctcggtctccgtgacctccaggtccatgaagttgggcacttccacggtgaacacgctgcccttgtagctcaccagcttgcagacggtgttctccttcacgaagcggaaggcgtcgcccagcacgtcccggttcagcgggaccatgtcgtaggtctcgggatccataaagtagtacaggtcgccgtcgttgtagctatactcggcatccttgcgctccacagtggcctgctcgaacttggcggtggggttgaaggactcctcgcggatggcgccggtcatcacgttcttgtacttggtgcgcacgaaagccgcgcccttgccgggcttcacgtgctggaactccaccacggtgcaaacgctcccgtccttctcaaaagtgacaccattgcggaaatcgccggcagtaatcgttggcataaatgatcctcctctgaaatctcaagaaaagctgaccagccggccgcctctctatctctacaaaaattcctctgctattttatcctatgttgtccggtaatgcaagtatttttcaggactttttttccattttgcggcggcagatagccttaaacggggcctggagagcgtggagcaccttctgccatgccgtcacggcgccgcccaccggctccaccatcagaggcaggactccggcccggttggcggccagcatatccgtcagcagcttgtcccccagcatggcggtgcagacccggtccgccccagcccgtgccatggcggcctccaggcccctgggactgggctttcctgcacggccctgataaggcacccccaggtccgcgcagaactccgtcacccggctgccggagcggttgttggagacgatcatgaaaccgatccccgcattgcggagggcggcgatccagtcccgcagggactgatccggccgacgggtcttcttggcggccagggtgaagtccaggtcgctgagcagcagggtgatcccctgctgccgcagccagtccggcgtgatctcgctgtaatactggaacacccagcggggcgtcagggaaaacggcataagcggctccttctctgcatagtctccttttagtataccagtcccaacgggattccacaagggggagttcattttgcagatctatctggccgtgacgccggccgaggcccaggaggcctcccgcttccgctgttccctggcccatgtggcctactgtatcgggccggactccacgctcctgcggcagaacctgctgctccagacccggggcgggctattgtccgtcacagaccggggcgcgccctttatcgccagcccggagcggctgtcggccgccgcgctgcgggagtgcgggcggcggagctacggcggcgtactgctggatttcgagcagcctcctgcgccggaccggctggcctttgcggagacgctggcccggcgcctgtcgccccgccccgtttatgtgccggagtcctacgccgcggcgtcaggcgccattcccctgatctgcaccgccatctccggcgggaactttgtccagcgcctgcaggaggccgctgccggacgggacagggcaggcggtctggccctggatgtccagcggctgcggatggacttcaccctcccggctcaaagcggcgaaggccgccctctcagcggccgggaactccaggacctgctggaccgggagtccccctccgttttcttctcccaggacctgtgcgcccggtatttcacctatgcccgggacggcgagacgcatttcgtcctcttcgacgacgcggacaccctttcccagaagctgcggaccggcgggaacatgggcttcgccgccgccttcctgatgtatccggaggtgcaggatctgctgcccaagctgtttcccgggcggaggacataaaaagtgctgtacctttcggcacagcacttttccttgacagatcaataatagcgcttcttgttcttgcgagcggcctcagacttcttgcggcgcttgacgctggggctctcataatgctctctcttccgcacttccgcgatgacgccggccttggcgcagctgcgcttgaaacgcttcagcgcgctgtcgatggactcgccgtccttcacatggatctcagacatctatatttccctccctccgaggtatccggcttaatccaggatactttaagggccataatctatggctttaacataagtattatacaaaccttccgggccgttgtcaagagattttccggaaaatcagcatttctcccgggagatcagtccgccgctctccggtacacgatgggcacatcgtacccgaacgtccgctttccgttcacctccatggtctccgccacctccagggactcctgagagaatcgctcatacagggtgaacttcagcaccggggagaacatgctgacgctgcccccctcccacacgccgtcgtgcagcgtatagagggcaggcgtgaatttctcggagatctccagatcctcccatttcaggggcggcagcgtctcataggtggccgcgccgccgtccgccgccttgggcagctgataggatgtcagcttcaccgcctccccctcctccgtaaagaggaacagatggggtgaggcgtgggtctttccctccgtggtgtagtagctctcctccagcacaaatgctcccgcaaaatccgcggggaggccgtcaatcttgtcgttgcacacggtgttgacatgctctgccagcggcagggcggggctgccgctccgccgcagctcctccagctgccgggtattgtcaaacctgccgcacagcaggcgcaggaattcatccagacggctcataggttctcctttctcaggcagggcctgaagcgcaggccggacgggatttcccgtccggccttttggtgtgattgggatgaactgggatgctcccaccagatgcatcggccggttcccggtccagcggggctcccgcatcggaatgcagccggacaggcacaggccgtccgccccaaggttgttgcctccggcaaaaacgcttgtacgcaccgctgggcgcagtcttatttcgcgggcttgacgatcaggttcaccagccggttcttcaccaggatggtcttgatgatctgcatcccttcggtggccttccggaccttctccaccgccagggcggcatccaccacggccttctcctcactgtcggttggcatggagatggtgcccttcagcttgccgtttacctggacggccagctccactgtggaggccacggtcttgctctcatccgccacgggccactccgcctggcagcacatcttgcccgtctgggcggcgaagcccaggttctcccacagctcctcggtgatgtggggggcgaaggggttcagcagcaggagcagatacttcaggtcgccccgggtgcagccgttggcgttcagctcgttcaccatggtcatcatggcggcgatggcggtgttcatcttcagactgtccacatcctctgtgaccttcttgatggtcttgtggatgacggcctcgttggcgggggtcacatcatagctgtcggaggcgctctccgccagattccacacccggtccaggaaccgcttggagcccttcaccgcgtcgttggaccaggttgcggccttctcaaagtcgccgatgaacatgatatagaggcgcatggtgtcggcgccgtactggtccacgatgtcgttggggttcaccacgttgccccgggacttggacatcttctcgccgccctcgcccaggatcatgccgtggcttgtgcgcttggcatagggctccttggtgggcacggcgccgatgtcatacaggaacttgtgccagaaccgggagtacagcagatgcagggtggtgtgctccatgccgccgttgtaccagtccacgggagaccagtagtccaaggcctccttggaggcgaatgccttgtcgttgtggggatccatataccgcaggaagtaccagctggagccagcccactggggcatggtgtcggtctcccgctgggcggggccgccgcacttggggcaggtggtgttcacccagtcagtcatcttgctgagggggctctcgccggtgtcggtgacctcataggagtccacctccggcagcagcaggggcagctgctcctccggcagggggacccagccgcacttggggcagttcaccagggggatgggctcgccccaataacgctggcggctgaacacccagtcccggagcttgaagttggtcttgggacggccgatgccctgctccgtcacccacttcttcatggtgggaattgcctctttcacggtgaggccgtccaggaagccggagttcaccatgatgccggtgtcgtccttcagggtgaaggcctccttggtgatgtctccgccctggaccacctccacgatgggcaggccgaacttggtggcgaactcccagtcacgctggtcgtggcccggcacgcccatgacgatgccggtgccgtagcccatcagcacgtagtcggagacgaacaggggcacgtgcttgccgctggcggggttgacggcctcgatgccctccagccggacgccggtcttctccttgttcagctcgccccgctcaaagtcggacttgcgggcggcctcctcgatataggcggccacagcatcccagttctggatctggtccttccactgctggagatagggatgctccggggagatgaccatataggtcacgccgaacagcgtgtcgcaccgggtagtgtagaccgtcagcttgtcgccgttggtggcggtgaagtccacctccgtgccctcggaccggccgatccaattcttctgctggatcttcacccgctcgatgaagtccaggtcgtccaggtcgtcgatgagccggtcggcgtacttggtgatggccagcatccactggctcttctccttgcggatgacctggccgccgcagcgttcgcacacaccgtccacgacctcctcattggccaggacgatcttgcagctggtgcaccagttgacgggcatggaagccttgtaggccagccccttcttgaacatctgcaggaagatccactgggtccacttgtagtagctggggtcggtggtgttcacctcccggtcccagtcgaaggagtagcccagcatgtggagctgcttgcggaagttctcgatgttgtcgtgggtcaccttggcggggtggatgtggtgctgaacggcgtagttctctgtgggcaggccgaaggcgtcatagccgatggggaacaggacgttgtagccctgcatccgcttcttccggcagatgatgtccatggcggtgaagggccgtgcgtggcccacgtggagcccctggccggagggataggggaactcgatcaggccgaagaacttctcccgagtcttgtcccccgtgacggcggtgaagggcttctcctccagccacttctgctgccactttttctcaatgctggcaaaatcgtatttcatatccttctcctcattcctgtgaatggatttctctgttcgatttatttttgccgcggcgcgcccccgggcggcctctcttgcttctacggggcaattcaccttctgtacgtggcaaaaatactttgacccaaccgccttgggttgtgtcgccagtgactgatgccgctggtgaaggcactctgctgcgcagccgttggcggctctgccgcctgacggatgcggtgtgcccctgcgggcaaggagatgtcaatcccctctttaagctgtaaaagcgcccccgaccttacggtcaggggcgtaaaagctacgcggtaccaccctggtttcgccagccgttgccggatggcgctcaacggcccggagggcctcggccagtaacggggcctgccgtcccaccctactatgtccgttcaggcgggagactccgggaacagtcatccgcgaaggtcccccaccggctcgcagcaaccgccggctctctgaaggcgggacatttcgcctttcttcccatcaatgtcgttaacgggtctattttatgtggctttgcgcgttttgtcaagaggtaagcgggaaaagcgctttacaatccagtcgacatcttgtttttgcccgtcctgctctgtataatggggaaaatccaacgtatggcagcagaaaaaactctggcaattttggggggaggcgaaaccgtgaagggcaccctgataaacacgcccacattggaaaccgggcgtttgatcttgaggaaattcacagagcgcgatctggaatggctgtttctgattctccatgacaaggaagtcaatcaattcctgccctggtatccgatagacagcatagaagaagccaagaaattctatgaagaaagatacgcttcaaaatatgtccagccgcaggcatacgcttacgcgatctgcttgaaaacggacgatcatcccatcggctacataaaagtggatatggaggaacatcacgatttcggatatgggcttcgcagggaattctggcatcagggacttgtcacagaagcgggcaaagcggtgatcgcccaagtgaaaaaggacggcctgccttatatcacagcaacgcatgaccgaaacaacccaagaagcggcggcgttatgcggaacgttggaatgaagtaccaatattcttacgaagaacagtggcagcccaagaattttctggttacatttcggatgtaccaactgaatcttgatgggaatacagatcgggtttacaaaaaatattgggaccaatctgctgcccattttatagaaccgaacgtgtgaacagatggatattggagaaaagttgggcgccgaggcagccggacttgttaaaaccgaagtgcttggtgcatggacctgcctcacaggaagcaggcccattttcatacaggcgcgcccaatgcgccctcacacttcgcagggaaggcttttcgccccctgacttatatcgctgccccttgattccgattgtttcatactcccccgccggtcgcctgatgcagcagctcctccgctggcacaccgaagagcttcgccagggccagcaggttggaggtgctggggtccgccgtgccggtctcccatttgctgaccgcctgccggctgacccccagggcctccgccacgaactcctgggtcatctggcagcgcatccggtgggccttgaggacctctcccaaggtgcggcgggtctccgctttttccctgcgggcctccccgccccgcaggtacttccgcagggcccggatcagcaggatcagcagataaatgagccctgcccagatggccagaaacaggagcagcagcgggagcatgataatggaactgaatgccattgcagttgcctccttttgttttggtggtctcagcatacccggggcgggcggttgcgtccaccagctatcgcgcaactctgggttgataagcagaaaaaagctccggcggtcagcgccgtcggagctgatgtttccccttttcaccggacacggcgccccacaaaatcttcgttttgcgtggcaccacattggactcaaatgggcaggcagagcctgcccatttcatatttttgcctgcggcaaaacgcttggacacgccacttggcgcgaagggcgatcaattctccgtcagcacaccggagagatccaccggcttgccgtcgtgccaaagccgctccagcgaatagaactcccgggcctcggcggagaacacgtggaccaccacacagccgtagtccagcaggacccaggtgccgtcccggtagccctcccggcggagaggatcctcccccgcctgctccttcatggccttctccactgcgccgcacagggcgttgatctgggtgttggaattgccggtggcaatgacgaaatagtccgccagggtggtctgctccgtgatctcgatggcggcgatgtcgccgccctttttctcgtccagggctttggccgcagtcagggccatctctttgggtgtcatggactcatcctttctgatcgtttgaatctgcggcacacctgccgctcaggttacaataataaacccgtcatccggggccgcggttccgccgtcggacgtaccggggtctacaggaggcgccgtctcaccatcagacggctgggaatccggcgactccggggcggttccgccgctctcacctgccgccgggtctccgctgccgcccgggagctggccgatcacctgtcctgtaccggggtccaggatctgcccggtgccgggatcgatgatgccgccggtctccgggtcgatcaggtctcccgtgtccggatcgatgctccccgtaccgggctccgtggctccgccgggatccgtggtctctccgtcgccgggcgtcccggccgccccgccggtctccggcgctccggcatcagggccggtccctgtgccggtctccccctccgggggcgtctcctcctccggctcctggggcgtccactgggcctgccagtaggaccggggatgggtggcgttgctgtcttccacatgaccggtggaggagctgacggagccgtcgctgttcacggtcatcatatccagatcgctgcgggtaaatacctcggcgtaggggctcaatttggtgttcaccagctccagcagttcattgggatagggggtcacataagaggcctccgagtattcgccgttcgccttgctgatagacgcgctgtaagcataagcactgctgttacccggcatggtgacgaattccacgttctccgccttcaggccacctaaaaatgcggcctgcgcaaaccagaggatgttttgaaacgtcaggtttgtctccacattgtcctgaaatacctgaatgaactgccggactttcggcacattttccactttcagcagttgctcgaccatcgccttcaaaaacgcctgctgggtcttgatgcggcccacgtctccctccgggtatcccagcgtcacgccgttcttgcggttgtcatggcggtaacggaggacttccatggcgtcctcgcccgtgagcaggcgatagcctttctcctgatggatatggaggttttgaagaggatcatcatagttcatattccggggcacatcgaaccagacgccgcccatggcgtccacgatttcacccacggcctcccactccacaatcacctgataatccggctcaaagcccaccagctgggagatctccttatacagggcctggataccccggtctccgccgccataggtattatagacagagttgatcttcttgatatcccaggagacattcaccatagtgtcccggggaatggacatcaccgtggccttctggttggtcacgtcgtagctggccagcagcatcgtgtccgtattgccgccgccccccgtgtcccggcccaggatcagaactgtgtagtagtcctgactcttccgctccccgtcgctgcgggggcgggtcccctcgccccagtcgatctcctccaccggatcggtgggttcttccgtctcctggggctctgtcttgccggtgttgaggtccggccggacgaacaggctctgccaggccagaactcccgccagggccacagccagaactgcggctgcggcaatcagccccttctgccccctggtcagtccggaccgtctctttgggggacgtccttttccatccatctggtccgccatggtgccaccccttttccgtcattcagctcacgatgataaagccgtcatccggagcctcttctgcggcagcatcgccgcctccatctccggtgccggaggtctggctgtctccagtgcccgaatcggtcgttcctccgcctgcgtcaggcgtgccgccgtccggagtcccgcttgtgcccgtacccggatcggtggtcccgtcggtgccggtgccggtggttccttctccggtgtcaggtcctgtggtcccgccgccggtgccgggatctgtcccgccgtcgggcgttgtccctgttccgggatccgtcgtgccagagcccgggtctgtggtcccgcccgtccccgggtccgtggttccgccatccggcgtcaccggcaggccggtgtccggatcgatgggattaccgttctcatccaccgtgggcgtctcctcctccggcttgctgggcgtggtaggcttcaccggcggccgggccgcccggctgtcttccacatggccggtggacgagctgatgctgccgtcagagttgacggacataatgtccaagtcgctgagggtgaatacctccgtataaggactcagcttggtgttcaccagctccagcagctcattcgcgctgggcaccacgtaggattgatagttgtgataggtgcggctccagcaggatgcggtccggttgggcatggtgacaaactccacgttctccatgctcagcccacccagaatcgcctgctgggcaaaccataggatattctggaagctcaggtctgtctccacattgttctggaacacctggatgaactggttgatctttgtgacgttcttgatctgcagcagctggtccaccatggcggtcagaaacgcctgctgggtcttgatgcggcccagatcgccgtccggatagccgtagcgcatgtcgttgtcgtggcggtagcggagcacctgcatggcgtcgtcccccgtgagcaggcggtagcccttctcctggtggatgtgaaggtcctgataaggatcgtcgtagttcatgttccgtggcacgtcgaaccagacgccgcccatggcgtccacgatctggcccacggcgtcccactccacaaccacctgatagtccggctcaaagcccaccagctgggcgatttccttgtagagatactggatcccccggtctccgccgccatagtagttatacacggagttgatgcgcttgatatcccaggagacattcaccatggtatcccggggaatagacatcaccgtggccttctggttggtcacgtcgtagctggccagcagcatcgtgtccgtgttgccgccgccccccgtgtcccggcccaggatcaggaccgtgtaatagtcctgactcttccgttccccgtcgctgcgggggcgggtcccttcgccccagtcgatctcctcttcctgggtcccgctgtccgcatccgcgttcttctccggcagatccgggcgaacgaacaggctctggcaggccaccaccgcgatcagcacgatggccagtaccacggctaccgcgatcagcagcttctgctgccgcgtcaggcggctcggtttcttcggcttcttgggtctgctctttttcggcgtcccgcccgccggatgctttccgttttctctatccactgtctctctatcctttcaatgcgtcccgcgcctcaatggtggcgtggtgcacagggtttcccatttcggtcatctcttcgatggtcatctccaggcccatcagcaggccctcgtccaggtctttataacacacagcgcggagtttgtctacccccggaaaattccgggagggctcgatataatccgccagatagatcactttttccagcagggtcatgtgggcatggcccgtggtgtgccaccagatggcgttgtagatttcatcgtccacaccgaacacgtcccgggcgatggccgcgccggtcttggcgtggagaagcttcagggccttctgctccagctcgtccagctggatgccgtaccggccgcacagttccagctgctcctccatgttcagcttttttgtgcagtcgtgcagcagtgccgctacccgggccttctccacatcggcgccgtaccgctccgccagacggatggcctcctgctccgtgcccagcacgtgggggatgcgcttgtttttcaaataactcagagctatcggccgcagctcccgcaggggcaggcgcttcaaatccgcccgggtgccgtacagtccctcccgcaggatatagccgtacaccgccggaggcaggagattcacgccctctcccttcgccagcatggttcgcaggtctgtggaggacacatccaccacgccggggatggtgagggtgaagatccgggcctggggatatgtccggtacagatagtcccgctgaacggagaacagctcctccgtgtccgcctccgttcggccgaaggtggcgatccccgccagggacagaatcttctccgcttcgtgccaggtctggatggtgaggaacatgtccgtgcccatcagcagccacagctcgtcctccgggtaccgctccttcagctgggccagggtgtcggaggtatagctccgccccgtccgcttcagctccagatccagtacctggacccggtcccccaggcccagctgctcccccgccaggcgggtcatctcaagccgctgttccggagtggggctgcccgctggcagcgccttgtggggtggctcccggtccgggaccagcagcagcaggtccagcttcagcagctcgaataccgcccgggccgcggtcacatggcccaggtggggcgggttgaacgtcccgccgtaaacgccgatcttcatacgcgattcctctttatggttcagatttttccgccggaagctccaactccatctcgtcatccgtggcggtgaagccataccgctgatacagcgggcggcccatggcggtggtgtggagagaaaccgtcaaacagccccgctcacaggccgctgccgtgaggagatccagcatccgccatgcgatcccccggcctcggaaggcaggatccgtccagatgttcataatatggccggacagacccgcgggattgtgataggagggcatctcccggcggaggtccaggccgccggtggcggccagccgctctcccgccagcgccagaagcgcaatgtggctgccggacgccagggcctggcggtagtaatcccggaccgcatccggcaggccatgcggcagcgccgccgtctccgaaaggtgccggtaggtccggatggcccggaggcggctctccgtcaagagctccagatccccgatcccggcagtgcggaacgtcagttccatcgggcgccttcccgggtcactgggggcgcttctttgccggcttcaccagctggatgcgcttctccctgggcttggagtggctctcccggtacagcacgaacttcgtgccgatgacctgcaccacctcgctgcgggtggccttggccagctcctccgcggcggtgcgggcgtcgtagtcgatattgttgtccagcacccggcccttgataagctcccgggcctccagtgcgtcatccgcctgcttgatgaggtttgccccgataccgtccttgcccacctgcaggatcgtgtcgatgctgtttgccaggccccgcagctgggcccgctgtttgcttgtcagttccatgtatactcctttattccgggaaatggccccggtcttttttatttttcgtcatgccaggtagactgccgcagcttctccatagactcctaggcaatccactcttctgtatagccgcagctgcggcagacatacctctgaatttttgcatttacaaaaaaccgatgggaaaagaattgtacagccccggctccactgccagcaggtccgcgctgccgcatttggggcagcgtccggtcgttttcaccgcagttccctcctcatcaaaggtagacggttattttttcaaataagttgccagtttctccgaaaatgcccgcagagcttttcctctatgggagatggcgcccttctcctctgccgtcagctggccgaaggtcctgcccttctccggcaccaggaacaccgggtcgtagccaaatcccgccgtccccatgggggcaaaggcgatggcaccgtcgcaccggccctccgccgtcagctcgtccccgccgggaaaggcgcaggcgatggcgcaggcgaagtgggccgcccgggtagtctgtccccgcatgttctgcagcaacagggtataccgcccccggtcgtccagctcctccccgccgtaacgggcggaatacacgccgggtcctccgttcagggcgtccacacagagaccggagtcgtccgcgatggcgggcagcccgctggccgcgcagatggccttggccttcagcatggcgttttccacaaaggtggtgccggtctcctccacgtctacggagattcccacgtctgcggggctcaccacttccacccccagtccggagaggatatccgccatctccttcagcttgccggggttatgggtcgccaacacgaatttcataccgtctcctccttttccgccgcacggtccagacgcttgttccggatggtcagcaccaggtcgatggtgaccatggtgatatccaggatgtaaaaagccgccacataggtgacatttccactgatgaacttccccgccaagccgcagagatagcccacgatgatgcacacctcaaaccataggctcttgccctttgcagtacgggagcgcacggactttgtgatgttgaagggctaggacaggccgaagcagatcagcataatcatctcgaatacctgcgccacggaaaccatctccttctttcaatttgtggttttatcgcttcaaaatctcccgctggagcttcagcagctcccggttgcccttggcgcacaagcgcaccagctcctgttgctcctggggtgtgaaggcccggccctcgccggtgccctggagctcgatgatctcccccagctcattcatcacacagttcaggtccacctgggcacgactgtcctcgctgtactgcaaatccagcataagggtctccccgacgattcccgcagacaccccggtgacgaaatgccggatgggattggaggccagcacgccctcctccaccagcttccggcaggccagggccagcgccacaaagccgccggtgacggatgcggtgcgggttccgccgtcgccctggagcacgtcgcagtcgatggtgatggtatgctcccccagcttcgccaggtccacggcggcccggagggaacggcccaccagccgctggatctctgcgctgcggggcgagagcttcagcttggcgatgtcccgcttgctgcgctcccggttggcccggggcagcatggagtactccgctgtcacccagccggtgccctccggcacatggggcggcacccggtcctccacgctggcgcagcagagaaccatggtgttgccgcactggatgagacagctgccctccgcgaattttacgaaatcaggggtgattttgatcgggcgcagctcgtcaaacgcccgtccgtcttgtctggtcatggtatgcgctccttttcattttccccgcagagaggactggatcgccgcgaacgcacggtcatagtcatccctgtgaacatagatggtgtaggtcaggacgctgtcctgtacagcagtcggagcggccccctgctgcggcgggcagccgcggcgtataggccccgggtcctggtgccgctggagagcccggcatctgaaagcgccccgcggatcagaaagtacatctgctgcgacgacacagagatcagttttctccgattccaaatggtgatccttgtctctctgctgccgctcaaataatggcctccacatattccttcgcgtcgaagggcttcaggtcgtccaccccctcgcccacaccggccagcttcaccggtacgcccagctccttggcgatggcgatgacgatgccgcccttggccgtgccatccagcttcgtcagcacgatgccggtgagtcctgcggcctccttgaactggcgggcctggatcaggccgttttgtccggtggtggcatccagcaccagcagcgtctcccgtgcggcgccggggcattcccggtcgatgatcttggagagcttggcgagctccgccatcaggttagccttgttgtggaggcggccggcagtgtcgcacagcaccacatccacccctcttgccttggcagcctgcagggcgtcgaacagcaccgcgccggggtcagccccctcgtgctggcgcacaagttcgcagccggcccgctccgcccagatctgcagttggtccgccgctgcggcccggaaggtgtccgccgcgcagaagaggacccgcttgccctcgcttttcagctgatagcccagtttgccgatggacgtggtcttgcctacgccgttgacgccgatgaacagcaccacagcaggccgggtcgagagatccagctccgtgccgcccacgtccatctcctccgccagaatgtcccggagggcggccttgaccgcctcctggtcctggagcttctccttccggaccctcgtgcggagtttttccacggcgtccagcgccgtgtccatgcccaggtccgccaggatcagcgtctcctccaactcctcgaaaaaggcctcgtccgcctcggagaagccggagaagagatttgtggtgatctttttcagcttgtcaaaaaagcccatggtatcctcccaaatcggaaatcagcgccggagaggtttatcccagtccaacctgtttccgcagtatttgcagtattcgccgggaaaaagcggcagatgtgccccgcactccgggcagcggatcacgaacaactggatcgcaaggcccgccgccagcagcagtcccccgatcacgcccgcctccggtacaaatacggtcctgctgaggaactgcagaacaaatcccgggactagcaggataacgctcaggatcgtccatctgcgcagtgtcatgagatcgtcctcccaatcgcttcaaatcctcttgcgccgggtcgccgttcactccactttcttgccgcagtatgggcaggtcttatccggtcggagctcccgaacggactttccgcagtgggggcagcgcagcagccaccacactagccccagatccaaaaggaaaatcagcagccctgcataggtcatccatccgccccggaagataaggaggcctgccagcaggcccacccagatgatcagtatctgtttatgcttgcgcttcatggattccgctccttatttgatcttcagctctttcgccatgtcattcagattgatggtcaggatcttgctcacgccctgctcctgcatggtgacgccatagaggacgtcggcctcctccatggttccccggcggtgggtgatgacgatgaactgagtccggcctgccagcgtccgcatatagcgggcgtagcgggtgacgttggcgtcatccagagccgcctcgatctcgtccatcacgcagaagggcgttggatggactttcagaatggagaaatacagcgcgatggccacaaaggccttctcgccgccggacagcagggagatggtcttgagggtctttcccggcggctgggccttgatctcgatgccgcagcccaggatgtcctcctcgtcctccagttccaatctggccgtccctcccccgaagagctcctggaaggtggtctggaagctctcggacagcagcttgaactgctcggcgaaaatcttggtcatctcctccgtgatctcgccgatgatgttctgcagctcgcccttggccttctccacatcgttgcgctggtccgtcaggtaggtgtagcgggtgttcacccgctggaactcgtcgatggccccgatgtttggggtgcccagggcggtgatgtcccgcttcagctccccgatccgccggttggccttgggcacgctctccagctcgatccgctgtgcctgggcgtcggagtgggagagttcgtagtgttcccacagccggtccaggatctgcttttcctccatggcggaggtggcccgcttctggtccagcttggccaccgcccgctccaggttcagcaggttctcgttcatctcctggcccgcccggttcttggcagtccgctccgcctccagggcgttcttctcctctgtgatggcggccagccgctgccggaaggccgcgccccggcccgccagctcctccagcgccgtctgcaatccggcgatctcttcctccgcggcggcgatgtttcggcggtaggtctccgccatctgttccttctgctcccggtcaccagagagatccgcgcacagcgcccgcaggtccgcggcgctgcggactgtggcctcccgctcggccgccagggcagccagatcgctctttctgccgctgatctcctcggccagggcaccggatttctccagcagctccgattggccggaaagagccgcctccgcctgggcccgcgcgtccgcggcggcggattcctgtcggttgatctccacctgggcggcggcagaccgggcgtcgttgtccgtcagccgtccggccagactctccagctcgccgacgaggttctccacgctctcctccagggagcgcagcaggagatcatattgtcccctgatgccctccagccgcaggacctcgtcctctgcgtggcggcgctgggcctccgcggtctccagctcgtattgggcggcggccagttcccgggcggtatcctcctccgcctgctttgcctccgccagctttgcctgcatggcagcggtccgggcggtgagctgctccaactccgcggaccggctcagtacaccggcggaccggctggtgctgccgccggtcatggagccgccccggttaatgacttggccgtccagcgtcacgatccggaaggcgttgcggtacttccgggccatggcgatgccgcagtccaggtcctccaccaccacagtgcggcccagcaggttgtaaacaatattccggtacgccgggtcaaatgtcaccagccgggaccccaggcccacaaaaccaaattccttctccacgcctttttcatggagctcgtcaccccggatggcggtgaggggcaggaacgtggcccgtccggcgtcccgctgcttcaggtagctgatggcggccttggcatcctcctcccggtccaccacaatgttctgcagtcccgcccccagggcgatctcgatggccaaggagtacctgccatcggtcttcaccagattggccaccgggccatggatgccctgcaggccgctctgtgcgcggcacacgaacttgaccgccttggagaagccctcgtactccttctccatctctgtcagcaggcggcggcggttttccagcgcccccgtgtccatggtcagctggacccgccgctccgcggcggcagcggccttcttcttccgttcctccatccgcaggctgtggccggcgatgatgttggcggcggcctccgcctcgtccctggcatcctccagggcgcggcggttctcccgcgcctcctgccgggcggactgaagctgctcctccgcggcggccctgtctcgctctgcggcctcccgccgctcctggatctgcttcttctccgcggcggcggcggccagttccgcccgcgcgtccgcggcggcggccatggcgagggcctcctgtgcccgcaggcgctccgcctcgttctgggcgccgccggcctgttccgccatggtctgggcggtctccagcagggcggccagcgcaccgttcagctccccgatccggcggtcgatctccgccacccgggcttcctgctcctccgcctgcttcgcaaggccgccggaacggctctccgcctctgccagctccgcctccgcccgctggatgttctcccggttgtgggtgacggtgctctccagcacggcggcggcggactccttctccttgatctgctcctccagaacggcggactctgtccggacacgctcagcctccatgtccttctcccgcatccgctcgctgtaccgctccccctcggcatagagggcgtccagagcggcgcgggcctcgtcccgctgggactctgcggcgtgaaagtccgcctccagcttccgggcgcccgccttcagggtgtccaggttctccagccagacggagatctccagaaggcgcagctcatcccggagcaccagatacttcctggccttctccgcctgctcccgcaggggctccacctgaagctccagctcggcgatcttgtcattgatgcggaccagattctcctccgtccgctccagcttccgctccgcctcctccttccggtggcggaatttggaaatgccggcggcctcctcgaagatctcccgccgctccccgctcttggcggagaggatctcatcaatcttgccctggccgatgatggagtagccctcccggcccatgccggtgtccaggaacagctccgtcaagtccttcagccggacagactggcggttgatgtagtattcgctttcgccgctgcggtaatagcggcgggtgacggacacttcgctctcctccatggtggggaagatgtgctccgtgttgtccagcaccagcgtcacctgggcaaagcccacctggctgcgcttctccgtgccgccgaaaatcacgtcctccatcttggcgccacggaggcccttgacgctctgttcccccatcacccaccggatagcgtcggagatgttggacttgccggagccgttgggacccacgatggcggtgatgtcctcgccgaaattcaggaccgtcttgtctggaaaggacttaaacccctggatttccaatgcgcgcagatacaaactctcacctcattcggcctctcagccagatcacatactataactagtatagtatagcaaagccactcccctatttcaaggaaaaatctccaggttcggcggctccagccggagctgggccgttatcctcgaaacagatctcgctttttccattttttcatgttattcttttgaaaaaataacgagtagaggagggagtccgtgcgagaaaaaagcccccggctgatcgtgacgtttcacaccactgccggggccatcgccacagagcagctctgccgccgcctggggctggagggcaaactgatctccgttccccggtgcatcacatccgactgcggcatggcctggtccgcgccgccggagctgcgggagcacctggagacccggctgcaggaggccgggatcgagacagccggtttctatgagctgcccctgtgacgattttcatcccagcgccgaagagagtgaggagtgtatttatgagagaaaagagttggtttcgggaatacggattgatcttggcggcgggcgtggccgtgggcattgccgccctgatccttaccgcctccggcaaccccaagaacatgggcttctgcatcgcctgcttcctgcgggacatcgccggcgccctggggctccacagcgccgccaatgtgcagtacatccggccggagatcatcggcatcgtggtgggggccgcggcggcagctctggctgccagggagttccgggcaaaggccggggcctctcccgcctgccggtttgtgctggggatgttcgtgatgatcggtgctctggtgtttctgggctgccccctgcggatggtcatccggctgggcggcggcgacctgactgccgttgccgggctggtgggcttcatcgccgggatcctggtgggcgtggtatgtttaaagaagggtttctccctgggccgggcctatcccgtccgcatgggcgaggggttcgtcctgtctgggatcctgatggcgctgttggggctgctgctgttggtgcccaccctgctgaagttctctgaggcgggccccggctccatgcgggccttctgggggatctccctggcggccggtctggttgtgggcgtgctggcccagcggagccggctgtgcatggccggcggcatacgggacgctgtgatgctgcgggacttcaagctcctctccggcttcctggccatctggggcacggtcaccattggcaatctggtcctgggatcctacagcctgtccgcactgtcccagcccatcgcccacagccagtacctctggtccgccctgggcatggccctggcgggctggggttccatcctgctgggaggctgccccctgcgacagttgattctggccggtgagggcaacggcgactccgccgtgaccgtcctgggcatgatcgtgggcgccgccgtctcccacaacttcggtctggccggcgcggcggattccgtggcggaggacggcacctatgtggtcggcggcatcggcactgccggcatggcggcggtggccatcggattcgcggtactgctggccatcacggtgacccatttgccgaaaacggaggctgtatcgcgtgattgagcacacaatgtatgaaaatcgtctatcgccctgtcctgacaggcaaccggcgatggcggaaaattttcccattttgcacagggaaaatccttgaatctgtgccgcatatcgcggcgaaaggggaatttgatatggtagatacccgcggatacatttgccccaccccggtgctgatggtgcagaaggccttgaaggatcggcccgccatggtggaagtcctggcggaggccggcgcagcggtggagaacatcacccgcttcgcccactcccagggctatcaggtcagcaagacggcggacggaccggactggaaactgaccctgacgaaataaaagacaggcggggagcccgtaggctccccgcctgccgtttttcctgtcccgcggtttgaggtcaggatgtctcccgctttcctttggcctcctcgatctggcggtagaggcactggagtccgtcagagaggccgcccacctggtcgatgatgcccagggacactgcctcctctccatagaccacactgccaacgtcggcggccatatcgtcctttttcagcatcagggcctggaacttctgagccgtgatctggctgtggctggagacgaaggccacgatccgatcctgaagccgctggaagtagttgtaggtctggggggcggcgatgaccgtgccgctcatgcggaccgggtggatggtcatggcggcgctggggacggcaaagctccgtcgggcagccactgccaaaggcacgccgatggaatggcttcctcccaggacgatggagaccgtaggctttgtcatgccggcgatcagctccgcgatggcaaggcccgcctccacgtcgccgcccacggtattcagcaggaagaggacgccgttcacctcgtcgctctcctccagcttggccagcaggggcagcacatgctcgtacttggtggtcttggcaccgctggcggcggtgttgtggccctcgatctggccgatgatggtcatgcagtacacggagccgtggggcgttttggtcagggcggagccgaagtccacgatctgctgggcgccgtcctttccgctctcgtcattttcctctgtggtgtccgcaggtttggtgcgttctgtcatggtaaaccctccttttccccggtattctctgcaattttatgaaaagtacgcgctggactttctttttgccggttactgtgatatgataaaatatctaaagtatctaatcttctactctggcccttctcaataaggagattcctatgaaacagcattttcaaatcccctgggctcagatcctgattgtttgcgccgctctagttatggcttttggaatggggacctctgttcaggtggagcaagaagcggtggggcaacgggaagccttccgacggagcctgcaaatgctggaccagtacctttgtgccctatctgaggatctgggtgatccggatattcttgccctggaggctcccttggaggatgatcgcattcaggaaaacctagtccgggtgcggcggacctctgttgccctcaaacaggactatgtctccaacgccgggagagagacttccccgcatccccacgtgtatctctatctcttggcactagaggaaacgctattggagagcaattatctggatctggaggcactttctcagatactgactatctgccgttccctgtgggatattgaaactggactttcctacaaggagatcatggcccagctggaggaaaacgtcacctccggggactaccaggacgccttggaactgctggggatcagcgatatgataccaattaccacccaaggaggaacataactttggaacagaacaaacagcgtattgtggtgaaggtgggcacctccaccctcacccataactccggcgcgttggacctttggagcatggaacatctggtgcggaccctggcggatctccagggcatggggcatgaggtgatcctggtgtcctccggtgccatcgctgtgggcaccgccaagctggggctgtccgagcggccgaaggagctgcggatgaagcaggcagccgctgcggtgggccagtgccggatgatgcacatttacgacaaattcttctccgagtacaaccgctccatggcccagatcctgctgacaggagatgatgtggaggacccggagcgggcggagcacctgtccaacaccttctccgccctgctggagatgggggtcatccctgtggtgaacgagaatgactccgtctcctccgccgagatcgagaccggacgccataaggtcctgggcgataacgacaccctctctgccatcgtggcggagctgtgccgggcggatctgctggtactgctcagcgacatcgatgggctgtacgacgcggaccccaagactcacccggaggcaaagctcctacaccaggtgacggagctgacgccggagatcctggagatggccggcggcgccggcagctggcggggcaccggcggcatggccaccaagctctccgctgcccgcattgccatggaggccgggtgcgatatggtcatcaccaacggcagacggatggaagacctgtatggcatcgcggagggaaaggacattggaacgcgatttgtatcggggaaaactaggaattgatggattgcacccccagcggaatgatttgaaattcgtccggatccgccggacccctaaatttccaactcctaattcctctttcaagaaaggtgtgacgatatgacagcattacagcagcagggacaggcggcaaaggccgccacctacgttctggccaccgccgggacggccaggaaaaacgcggcgctgaatgccattgcggacgttctgacagagcggcagacagagtggctctccgccaacgcagaggacgtggccgccgcgaaggaggcggggatgcgccccgccatgctggaccggctgaccctgacgccggaacgggtggcaggcatcgtggacggcgtgcggcaggtggctgcccttccggatcccatcggcagagtggacaagatggaaacccggcccaacggccttatcatcggccggcggcgggtgcccctgggggtcatcgccatcatctttgaggcccggcccaacgtcaccgtagacgctgcggcgctgtgcctgaagtccggcaatgtgtgtatcctccgaggcggcaaggaggccatccgctccaaccgctgtgtggcggagctgatgcgtcaggccctgcggtccgtaggtctgccggaggactgcatctccctggtacaggacaccagccacgagaccgccaatgagctgatgcacctggacggctatgtggacgtgctgatcccccggggtggcgccgggctgatccgggccgtggccaaggaggccagcgtaccagtgatccgcaccggcgagggcgtgtgccacatctatatcgacgatgaggcagacctggacatgggtgccagcatcctcttcaatgccaagtgctcccgtccctctgtgtgcaacgccgtggagtgcgtgctggtccaccgggacgtggcggcggacttctggaaaaaggcccttccccttctggatgagaagggcgtggagctgcgggcggacccggaggccctggagatcctgggcacccgggcggtaccggcagaagacagcgactgggacgccgagtacgacgactacatcctggctgtcaagacggcaggcggcatggatgaggccatcgatttcatcaatgcccacggcacccagcactccgaggccatcatcacgaagaactacttcaaggcccagcacttcctggaccacgtggatgcggcggcggtgtacgtcaacgcctccacccggttcacagacggcggcgagttcggtctgggggcggagatcggcatttccacccagaagatgcacgcccggggccccatgggactggaggagctgaccagctgcaagtacgtcatttacggtgaaggacaggtgcggtaagcgcctgccggaagttaaaacgccaagaggggatggtctctatggcggcgatcattctctccctgctggctgcagcgcttctgtcgaccgtgctgctcatccccgccggacacctgaagcaggcgctgggcatcccgtcggcggtctgttccgctgcggcgatggggctgtacctgcagatgcgcactgtctccggcgggcctggtaccggaatagcactggtgcagctgtaccttccctgcgctgtttacggactggtgatcctgggcggcgcggccctgggtccgacaggatggtgctgcggaaaaaagcgaagctgaacatctgattctgatttgaaaaaagaggttgatgcacaatggcgacatttggttttatcggcaccggaaatatgggcggcgccctggcccgggcggcccgcaagcggctgtccggcggagagatcctgttggcgaaccgctccgccaccaaagcggaggccctggcccaggagctggactgccgggctgtggacaatgcggcggtggccgctggggcagattacatcttcctgggcgtgaagccctatatggtggcagggctgatggagaagatcggccccgtgctggcggcgcggaaggaccggttcgtgctggtgtccatggcggcggccctcaccatccccgacctgcgggagcggggctgcggggactggcccctgatccgcatcatgcccaataccccctctgccatcggggagggcgtgatcttctacacctgcgacggcgtcacggcggaggaggaagcggcgttcctggagaacatggcaggcgccgggcggctgctgcccctggacgaccatctgatggacgccggcagcgccgtggccggctgcggaccggcctttgtggacctcttcatcgaggccatggcggacggcggcgtggcctgcggcctcacccgtcccatggcgatggagtgcgccgcccagacgctgatcggcgccgcgcggctgatgctggagacgggccgccatcccggtgcgctgaaggatgcggtctgttcccccggcggcgccaccatccagggcgtccgggcgctggaggccggcgggttccgcagcgcagtgatggaggcggtcatcgccgcctatgagaagagtgcggagatgaagtgaacggtccgtggccggaggcagctgcctccggccacggcattttttgtccgcctgcgggacttgccagcagacggcgagatgtggtatgatcgttctcccatctttttgacaggaggacatgtatggcacgggacatcatcttgaatctggcaatcagcctggatggcttcatttgcgatgaggacggcggcttcgcatggatcagcggccagggagatgtccgggccgacacggcggaccacttcgacttcgacggcttcctggcatcctgcgacaccatcgttatgggtcgaaaggcttatgaggactgccttagttctctgcccgaagcggcggaaaagcgattcctggtggcctcccggacacctcgggcgccggagggcagggttgtctttctctccgccgatgtggtggcggaagttctggcgctgaaggaccggcccggcaagcacatctggctgttcggcggtggagagctggcctccgacttcattcgcgccgacgccgtagaccggtatatcgtcggcatcctgccggtgatccggggcaagggccggcggctgtttcaggaggggattccgccggtggaactccatctggaccgctgcacggtctcagacggcatccctattctggagtacagccggcggggccggtaaggcagatagacaacagccgcagggagcgttccctgcggctgttgttttgtgatttgagaagatctgacttctgtcgctcaggcagcagcgttggcggcccggtacaggaaggtcacaatctggccccgctggcagacggtgtcgggagagaacgtgctgccgtcaccggtgccgagggtgacgccctgggccacggcccagttcaccgcggcggcgtagtccgcgtcagcggccacgtcggtgaaggaagcggcagcagcctcggggctgtcggcggcaacccacatgaagtacaccgccatggcgcgggtgcagcccgcatagggatcaaaggtctcgccttccaccaagccctgctcactgacccactggacggccttgaagaagtacaggctggtgtccgtcacatcggtataggcgggttccgtgctagcaggctccggagaaccggcggcgcgccacagataggtgatgatctgggcacgggtgcagttctggtagggagagaaggtggtggcggtggtgccgttggtgatgccctcgtccacggcccactcaatgccgtcatagtagggagaggtcgccgccacgtcggtgaaggccaggccctggtcaacagtgatgcggccagcgggctgaccgtaggcctcttcggtgacggtgccctttagctcgtcggtgatgtagtccatgaccacctcatccatggagaggcccaggtcatagttgacggaggcagccgcgaacgcatagtaggtgtcgccgccggcggccatgaagtcgttggtggcgatggtgtaggtggcgttggcatcaaagggctcgccgcccacagtctcgatggtgacgcgctggatgctcttggggccgtagtaggtggagccgggatactgctcgccctggtcataggccttggtggtgtccacggtgaactcgatgccgctcacctgggggaagccgccgatagaggtgggcgtgcagtaggtggaagcctccagagcctccagcagctcggcgccggtgactttcacgatggagagggtgttgccgaagggcagcacagtgttgatatccttcttggtgatgtcgccggcggcgatggaggcgcggatgccgccgccgttggtgacagccgcgtccacctcagtgccctcacgctcggcgccccagaccagagcgtcgcagatcaggtcgcccaggttggtctcctcggtacggttaccgggctccttctcgccgttcagggccacttcggtctttgcaaacaccgtgccgtattccttgtcgatctccgcctggatcttggcggcgcgggcagccacatcagcgtccgtggcggtcaggtcggcaacgggggtagtggcggtggtgatggtgccgtcggcatcgatggtgaccacgcccacgctctccagcttggtgccggtagaggtcaccagagtgtcgcccaccttcccggtaccgccagcggcggccttcacgtcctcaagggtggagtgagagtggccgtcgatgaacacgtcgatgccctccaccttctccagcaggtcgatggagcggttgccggtggactcggcatcgatgcccaggtggcccaggcagatgatgtactcgcagccctctgcctccagtgcgtccacctgatcctgcgcgcagtcgaacatcttatcgccggccaggaaggtcacgccctggatcttggcggggtgggccttggttgcggtctccggggtgtccaggccgaacacgccgatcttggtgccgtcgggcgcggtgaagaccacgttgtcctcaaaggccacctggccgttgtacaggacattggcgtccacgatggtgaagtcggcgtccgcctccagatccttgaggttctggtagccgtagtcgaactcatggttgcccatgctggccacgtcgtagccggccaggttcatcagctccacggcggtggcgccctcagacgtgctgacggtgggatcgccctggatgaagtcaccggcgtccatcagcaggacgtaggcgccgcgggcctcgtaggcgtccttcagcgcggccactttggcatagccgctgatggcgccatgcacatcattggtgtgcaggatgacgatgtcgccgtccagatcctgtgccgtctcttccgccgcattggcggtgacggccagggagaacgtcatgaccaccgccagcagcagggacaagactttctttttcattctgttacctcctctgaaagcgcgggagatgacctcccgtggtatggatatagtatagcacatctggaaaaaatggacagaggggacttcgcggatttttcgaaaaaaaccaccagaaatatcccacgttttttgtagaagaagcgcaatttttttctacccgcacttctggcattcccttgcggcgggtgttatactgaaaaaaagcgtctgccggagcttcccggcagcctgccgccgggcggccgcatcgtgccgcagacacacaaggaggtatatttatgaccacattgctcaggggcgggaccatcatcaccggtgccggacagcggcgggccgacctgctgctggacggggagaagatcgcctgggtgggccggggacctcaagccgcagaccgggaggtggatgtctccggctgtttcctcttccccggctttatcgacgcccacacccactttgacctggatgtggcgaacaccaccacggcggatgatttctgcaccggctcccgggcggccctgcggggcggcactactacggtcatcgacttcgcctgccccaacaagggcgagtccctgcaccacggcctggacctgtggcatcagaaggcggacggcaggactttctgcgactacggcttccacatgaccatcgacgactggaacgagtccatccgggcagagctgccggacatgttcgcccagggcatctcttctttcaagatgtatctcacctatcccgccatgatgatcggcgaccgggacatctactgggcactgaaggagctgaagcggctggggggcatcgccggcttccactgcgagaacgccggtgtcattgacggcatgatcgccgagcggaaggccgccggagagctctcccccgcctcccacccccgcacccgaccgccctatctggaggctgaggcagtgagccgcctgctgcggatcgcccaggcagcggacgcgccggtggtcatcgtccacctcaccaaccgggaggccctgctggaggtggaccacgcccggaagcggggccagaccgtgtatgtggagacctgtccccagtacctgctgctggacgagagcgtgtatttcaacgaggactactccgccgctgcccggtatgtgtgcgcgccgcccctgcgggacaaggccgagcaggagcacctgtggaagggcctgcggcggggcgctatccagaccgtgtccacagaccactgctccttcaccctggcccagaaggacatgggccgggaggacttcaccaaaatcccaggcggcctgcccggcgtggagacccggggcgagctgctgtactcctacggcgtggccaagcggaagatcagcgccgcccagatgtgccgggtgctcagcgagaatcccgcccggctgtatggtctctatccccggaagggcgtgctgcggcccggcagcgacgcggacatcgtggtctacgaccccggcgccagccatgtgatccgagcggaggactgcgtggccaatgtggactacaacccctatgaaggcttcgtcaccgccggcggcatccggcaggtgtggctgcgggggcagctctccgtggaaaacggaaaggtcctggtggaggcgccggcgggcaagtatatggcccggggcaagaactccctgtgagcattcgtccatgaatctcgtcatcatcgggcgcttccctgcggccacagacacgcagatcagggcattccttcccgctgaccgggaggtttttatcaccgaatcggatctgtccggcccctttttgcagagtgcggatgcgctcatcccggaacacatcccgattccctcttttggggacaaggctctgaagctgcggatgattcaaaccggggccgggtatggcgaagatagagccgtctgcttttctggtcaacatggccaagagggatcgttcacgaagaggtcctgatcgaggctttaagcgaccatcagatcgccggcgcttgcccggatgtctttgaggcagagccattttcccaagcaagctggctgagggcgctcctcaacgtaatcctcgcgccgtacacagcaggggatcctggcggcgtgaaactgcacgaaaaacaggattcctttttcccagtagcatccggcaggcacggagcggagaaatgcccgccaacatgctgaaccgggacacctggaaggcgtggagataagccccttctgcaggtggacagcccatagacgtaaaagagctgtgcgttcaactgaaaaacaggcgtctgcctcatttggaatgaggcggacgcctgttctgcttttcatgcgtttctgttactcttctgccagtccctcccactggacatccacgatggtgccgccggagaactcaatgtactcactcttcaaaatataatccgtcttgccgatccggacctcctggtctcccaccttggtggtcatgacctcgccggcaggcgtctccgtggtggcggtgaagagcagcgtcacatgctccggatcctcgatccactgcccatcggggcccagcacgtagtagggctccatctccacgctctcaatctggccgcccaccagagcgccggaggccatcagcggagagggcagatgggcctggcaggtctcgtacagctccgtgggcacaccctcgcacttaaccacataggtcaccttcaccatgccgccgtcctcggcggcggtgccgccgctgctgcccagcagcttccaggctccaaaagccaccaccgccacgatcaaaatcacggcgatgatgtcgatgatgttgaactttccaacgcgttttgctttctgttccatggtctcctccgtaaaaggcgcggacgcgcctgtatttggcgtttgtcgtctggacaatatctggttcgtattgtataatatttctcgcgatttcacaacccctatttgcggaaagcggaaagaaaggcattccatgaaggtcattcatctcatcagcggcggagactccggcggcgcaaaaacccatgtgctgagcctgctgcaacatctgaatcaaaccatcaccgcccagctggtgtgcttccgggacggcccctttgccgaggaggcccgccagatgggcattcccaccatgatctgcgggggcaacaacgtcttccgcacccggcggaagctggcggcctatatccgggagggcggctacgagatcatccactgccatggctcccgggccaacatgatcggcgccatgctccgcaaggtcacgggactgccggtggtgaccaccgtccacagcgactaccgcctggactacatgggccgccccctcagccatctgaccttcggcaccatcaacgccctggccctgcggcggctggattaccggatcggcgtgtccgacgccatggtggacctgctgatctcccggggcttcccggcggaccggttctacaccatctataacggcatcgacttcacgcccccgcccacccagggggaccggctggagtacctgaggagcctgggcgcagatgtggacgagaactctgtggtggtaggcatcgccgcccggatgaatccggtgaaggacatggccactctggtgcggggcttcgccgcgggccacgccaagtgcccccgactgcggctgctgatcgccggcgacgggccggagaaggacaagctcaccgccttggcggcagagctgggcgtagagcggcaggtgtgcttcgccggatggatctccggcggcatggaccggttttacagcgccctggacatcaacgccctcaccagcctgtccgagaccttcccctatgccctgacggagggggcccggttccatctggctaccgtctccaccgccgtgggaggcatcccctatctcatcgaccaggacgtgaacggctatctcttccagcccggcgactggcaagccctgggcaacgatctggccgccctgggcaatgacgatgaattgcgccgccgcttgggggaaaagctctatgaaaaggcgtccacccagttctctattcagaagaccgtgtccacccagctgcagatatacgcctccatcctccgccgccaccggcggcgctcctccgcccgggacggcgtggtgatctgcggcgcctacggccggggcaacgcaggtgatgacgccattctggaggccatcctccaggagatgcgctccatcgacccggacatgcccatcaccgtgctcagcaaggatcccaggagcacccggctcacctaccgggtgcgggcggtgcaccgttccaacttcctggcctggcacgccgccatgtggaacagccgcctgtacatcaacggcggcggcagcctgatccaggacgtgacctcccgccgctccctgtggttctatctggccaatatccgggcggcaaagcgggcaggcaaccgggtacagatgtacggctgcggcatcggccccgtcacccgggagagccaccggagtctggccgcgaagatcatcaacaaatatgtggatgtcatcaccctgcgggagccggactctttggaagaactgcgggccatgggggtgacggagccggaggtcctgttgactgcggacccggcgctgatcctgcagaaggccccggacgacgagaccgacagcgtgctgctgcgcgccggtatcccgccccacggcaattacctctgctttgccctgcggcggtggaaggggtttgaagagaaggcccccctcttcggcgcggcggcggaatacgcctaccgcacctatggtctgacgccggtgttcgtggcggtggaaaagcatctggaccccggtgcgggccagctggccgcccgcgggctgacgatcccccactatttcctggacgatgccggcggcgccgggaccatcatcggcgccctcagccggatgcaggcggtggtgtccatgcggctccacgcgctgatcttcgccgccgggcaggggatccccctggcgggcgttgtctacgaccccaaggtctccgccttcctgcggtatatcggacaggagcagttcgtggatctggcagagctgaccgggcagaatctctgcgccatgatggaccagtgcgtagcccaggcggcccacccggaggcccaggccgccgccgtgcggaacctgcaggccatggagcagaagaatgtggaggtggcccgccgcctgctgaagggttgacggggccacctgttggaggaatctatgaaaattatggtctatgaggcccgcccggacgaacgggcggacctggagaagcaggcggcgctccacggagtggagctgtctgtcacagacgcggtgcccacactggagaacgcctctctggccgccggctgcatcggcgtgtccatcctgggccaggggtgcatcgacgcggccctgctggatgcctatcacgccctcggcatccggtatctctccacccgcaccatcggatatgaccacattgacctggaccacgcccgatccatcggcctgcgggtgtgcagcgccagctatgcccccaacggcgtggccgacttcaccgtcatgatgatcctcatgtgcctgcggcattacaagcaggctctgtggcgggggcaggtcaacgacttctctctcaccggcctccagggccgcgagatgaaggatctgaccatcggcatcatcggcaccggccggatcggcgcccaggttgcccgaaatctctccggcttcggctgccggattctggcctatgacctgcggcgcaatccggcagtggaaccccaggtcacctatgtggacttcgacacccttctggcccagtcggatgtcatcaccctccacatgcctctgctggactccaaccgccacatcatcaaccgggaatccatcgccaaaatgcgggacggcgtggtaatcgtcaactgttcccgcggcgagctggcggatatcgaggccctgattgaggggatcgagacgggaaaaatcggcgccctgggtatggacaccgtggagggggacgagggcatcatccacgccgaccaccgggtcgacattctgcccaatcggaactggttctatctccaccagttccgcaatgtcatcatgacccagcacatggccttttacaccgatgccgccgtgtccagcatggtggactgcggcatcggcggcatctgtcagatggccgcaggcgagtcctgtcccactgagctgacaggcccggtacagtaagccgctacctcccgccgcgggtccggcggcgctggacggagatcgtctccagcgtctctcccagctgaaccagcagcgccgctgtcagctccaggtcctcgtcgttcagccgggcagccagagagaccgccagggtgttgacagcggtggtcagggccagcggatcacaggaaagttccatcatcgcatcaccgctctcattctatgcctgagcggagccattcatcctgctccgccggtgtgaacacattttagaaagggacggccgccctgtgagcggccgtccctttttccaaaatgcacgtgctcaatccctctccgtctcttccccgcctccctgctggaaggggggcaccggctcaccggcgtgataggcgttggtgcggacattgatatactgggccttcagcttggagtagacgatggtctggctggagtacagcccattgtagccggagagcatgtagctgatgccgcagatcagggcaaaatacagcagcccaccatccccgaacagctccacggacaggaagatggaggccagcgggcagttggtggccccgcagaacacagcggccagccccagcgccgcggcgaagccagccggaatccccagcagcggccccgccacacagccgaaggtggcccccacgaagaaggagggcaccacctcaccgcccttgaaccctgcggagagcgtcaccgcggtgaacagaatcttcagcagaaacgcctccggccgggcagtgccctgctccacggcggcggtaatgagatccatgcccgcgccgttgtaatcccgggtcccgcagaggtatgtcagggcaatgaccgcaccgccaccgacaaggacgcggagccaggcattgggcaggcgcttcttcatctgatgctccgcgaagtgcagggtccggcacagcagaacggacaccagggcgcagcctacgcccagcaccgccacccgcagcagcatcagcttctccagctccggcgccgccacagaaaagcgggtgggcgccacccccaactccacagaaatccagtaggccaccagggaggcggtcagacatggaatgaacgccacgtggtacaccacgccgatgctgatgaccacgatggcgaacaccgtggcggtaaggggtgtgccgaacaaggcggagaaaaacgccgccatgcctgccatggtggcggtgcgcaggtcccggtcatccagattgaaaaggttccccgcatggcggccgatggtgccgcccatctggagagccgcgccctcccgtccggcgctgccgccgcacaggtgggtgagaattgtccccaggaagatggcgggcagcagccagatggacaggggctttccgtggtgtaccgcgtcgatgatgtcgttggtaccctggccctccgtctttgtcagcttgtagaaggccacgatcaccagtcccgccgccggcagacaccacaacagccagggatgttgctcccgcagctctgtggcccgctccacaccgatgtggaacagggagcccaccacgccgcagcagacgccggtgaccagcgccaccgccagccacttggccatggcctggacgtaaaggcccacgcgggtgtggccatgctccttttccaatccgttcacttcccttccccgccgccgaagggcgggccgtgcttgcaatggaaatattatacggcaggccgccgttctttgcaacaggcatggtgcgccacgcgaaaagggccggtccgaaaatcgggccggcccgtattgtcaggcagactcaatcactttgcagcagcctttttcctgccccacatcttgttgccgtccttgtcccatataccaaagccggagaaggcgcagaggatggagaagatgggtacaatgaagatgaaccagcaatacgggatatactccgtgccgcagcccagtacctccatcacatacagcgtggcaacgccccaggggacgatgggtgcactcagggtccccgcatcctccagcgtccgggagaggaccctgcggtggatgcccatgcggtcgaaggcgtcctcgaaggtctgctcggtgacgatgatggccacggtctggccgccggccgtgaggaagttgacgatgtagcagtagatcagagtgacggtcaccaggacgccgcggctcttgatgaacttcagcagcacgtccttggccagcacgtccaggatgccggtggcggtgatgatgccgcccatgacgctggctaccatgaaggtgatcagcagaccggtcatgctggtaatgccgccgcggttgagcatcgggtccacaatgtccacgccggtagacagtgtgaagccgttggccgcatagttcatcagctccacaaagttcactccctgaaataccatggcgaacacgatgctgaccaccacagtgaggcccatacccagcagggccggcagcttgaacaccgacaccagcagcaccaggatggcgggcaggatcaggatgggattgaggttgaagtgctccgccagggtgtcgcagatcaggttggcgcgagtcgtatccatctcgccgccgctatgcatcaggccggcggcggtaaacagcaccagcgccaccagtgcagcgggaatagtggtgtacatcatggacccgatgtggtcatacaggggaaccctgctgacaccggaggccaggttcgtggtgtcggacagaggggacatcttgtcgccgaaccaggcaccgcagaccaccgcagcaatgaccagcggtaccgggatggaagtagtggaggccacgcccaccagggcaatgcccatggtcgccacgctgccgaaggaggttccggtgaactccgccgtcagcccgctgaggacgaaggccaggggcaccaggattttcggggagatcagcttcatgccgtagtacatcagggccgggaccgtgccgccggccatccagatgcccaccagcatgcccaccatgatgacgatcaaaaatgtcgggatgcagtcggacaccactcgcaacagcgtcctttccacatccgcccaagggatatccagcaggagcgcgattaccacggcgatcagggccgcgatgaacacggacatagtggtgtccacgcccaggttgatgagcgccaccagcacggccacgatcaccaggaaggagatcacggcgaaagccggagttggggtcttccgcgtcttgactgtctttgtcttatccattctcgtttctcccttctagattgtacggcggcgcgggaccgcgcccgcggcgccgcaggagtcctccgttcagcccagcagctcccgggtcaggaatgccagagccgagtccatccgggcggcccgaaacgcacaggatttgaatcggtgctccgcgccatggaccaccaggaattccgcccggtctccatagatctccttgtaccgctccgaacagtggatggaggccgtcacgtcctcatccccgtgtaccagattcacgcgcttggtgaatttggccgccacggcgtaaggatccagctccaaggcatcctgatagaagcccaggcccacccgcaggccctcgtagtctgcgtagcccttctcctcgatgtcagacacatccacgccgcagagcatcttgtgcttcatgttgtagaccacgtccggcgccgggcaccacaggctcagggcgcacacgtccgcatcccgcaggcccgccaccatggaggccacacatccccccatgctcaggccgtggatcgcgatccggctctggtccacaaagtccagactcttgacatagtccaagatggcaaggccgtcttccacctcactggagacagtcatgtcctcgaaccgcccgtcgctgtcgccgctgccggcaaagtcgaaccggacactggcgatcccccgctcacacagcctgcgggagagctccgtgtggacgaagttgatctcgttccggtcgtcgcagaagccgtggaacaggatcacaaagggtactttccccggccgctggtctggcacatgcagcatcccccgtagggtcaggccgcggctctcgcactccacataccgttccatctctcttcctcctttctccgcaggcaccgttccgctggccggcccccgcttggtttctgatctatgcaaagccgctccgcggcctcacatctcactcaggcctcctgccggaagcagcgcccctccacccgggcgcccaggcggctgaacagctcgttggtaatggtgccggcgttctccgccagctcctctgcgtagatgacacagtccccctggcggccgatgaacaccgcctcgtcccccacccggacatcttcaatgccggtgacgtccagcatcagctggtccatacagatccggccgatgccctgggcgtactgtccccggacgatggcccgcagctttccgccgctgaggcagcgggggatgccgtcggcgtagccgatggagacggaggccaccttggtgggccgctccgcccggaagatccggccgtagctcaccgtctccccgggtccgatctcccgcacagaggtgatccgggccttcagggtcatgaccggcatgggctgcaggtcctcccgcaggtagtccgccgcgctgctcttgacgccaaacatcaaaatgcccaggcgggcgtagtcataggcgtactccgggtagttcaccgccgcatagctgctcagaaggtgaaccgtccccagctccacgccccgggcctggagggactccaccacgcttttgaaggtctccgcctgccggcgggaaaagtccacatgttcctcctcgtccgtgtccgccacgcagaggtgggagtagatgccggtgacctgcaggacgccgttctcatacacccgccggatggcgtccaggtcctccggcaggaatccgatgcggtgcatacccgtgtccactgcgatatgtaccttgaggcgcacgccgttctcccggcagtaggtctccagctgggcggcgtggtccgggcaggtggcggtctgggtcagcccgtgctctgccagcaggtggaaatacgcaggggcgctgtatcccaggatcaggatctccccctggatgccggcctcccgcagctggaccgcctcgtccagcgtggcagtggcaaagtggcggatgcccagctcccacagctgggcggccaccgcccgcgccccgtgtccgtaagcgtccgccttcaccacgcccatgatccggcagcccgctggcagaaggctctggtagcgccggatgttgtgggccagggcctccctgtccaattcaatccaagtccgattcatctatctccctgccgccgcagtgcggcggcgctcccttcccaaaattcttgatcccgtcaagaggtcataccaatggcaatttttttcagaatacccgaagtctgccaaaaaagcaagttttctgcaagtttttttgtgcccctaaaactttttacgggctgtccgccgtcctctctcacaggcggactcatcccgcttttccggttgattctttccaattctgtgctatactggaagaggaaacagacagatgtctgcgcgccgatgcgaaaccccagaacaaaaaagtttggaggaaatgagtatgaaatacggacgtacctataatttctccgccggacccgccatgatgccggaggaggtcttggaggagatcgccgccgagatgatgaattaccggggcagcggcatgtgcgtcatggagatgagccaccgctccaaggtctttcagcagatccgggacgaggccgaggcggacctgcgtcagctgatgggcattcccgacaactacaaggttctgttcgttcagggcggcggcaccgtgcagttcgccatggtgcccatgaatctgatgaagaacggcgtggcctgctatgtggagaccggcaactggtcaaagaaggccatcaaggaggcccagaagtacggtgaggtgaagatcgtcgcctcctccgcggacaagaacttctcctacatccccgactgctccgatctggacatccccgacaacgcagattacgtctatatctgcgagaacgagaccatcaacggcaccacctatttccatctgcccaacaccaagggcaagatccttgtgtcggatcagtcctccatgttcctctcccgtccctgcgatgtcaccaagtacggcctgatctgggcgggcgtacagaagaatgtgggtcccgccggcatggcggtggtcatcatccgggaggacctgttgcgggaggacctgccccagttcgtgcccacttacatgagttacaagacccatgcggacaatgactccctgtacaacactcccaactgctgggccatctactgctgcggcaaggtcttcaagtacctgttggcaaacggcggactggaggccatgaacaagcgcaacgaggaaaaggccgcggtgctgtacgatttcctggaccagagcaagttcttcaccggtgctgtccgcaaggaggaccgttccctgatgaacgtgcccttcgtcacccccagcaaggagcaggatgccgatgtggtggccgcctccaaggccgccggcttcgacaacctgaagggccacaagagcgtgggcggcctgcgggcgtccatctataatgccatgcccaaggagggcgtggaggccctggtggagttcctgaagaagtacgaggcagagcacgcgtaacggctttccatgggggacctgctcccccatggaggccccccgtcagtctgcagactggtgaacgccgcccaaggcgtctgagtcggggaattttcggcaggtacacgccctgcggaaaaggattaaaaattcttcttttgcctccggcaaaagaactggggaaaccggcgaagcgccgccagcggtctcgaaagcgagccgatttcgagaccgcggcgcgattggcggcccaaaagggccgggaatcgcaatgccgcaacggtgtagcccccacgatttctaccagcccccttccttttgtgcgggtgggagagcgagtggaacacgccaggcgtatctccactcttcacgctccacatcttcactccggtgaagccagagaggcttcgccttcccccttcctgcgatggagtccggagcgtcaggcagactgccgtacgcgcagctcctatctctgaactccactctcacggaggcgcctgtcccccaatgggcgtttggggtttccgacattggcacccctggggtgtgccggaaatgtatgaaaaggggtattatatatggcattaagagttttggttaccgatgggatggatgctggcgcaatggaacagctgcgcaaggatggatatgaagtcatcgagcagttctatgagcccgatcagctgggcgcagccctgcgggacttcgacgtggttatcatccgcagcgccaccaagatcaaggagccgcagatcgacgccgccgcaggcagccgcctgaagctcatcatccgggccggcgtcggtgtagacaacatcgcagtcaaatacgcagaggaacacggcatccaggtgaagaacacgccccgcgcctcctccaacgcggtggcggagctggctctggccctgttgttctcctgtgcccggaacatctccatcgcgggccacaccatgcgggagaacaagtgggagaagaaagcctactccaagggctttgagctctccggcaagactatgggcgtcatcggctatggccggatcggccagctggtgggcgccaagggtcaagccctgggcatgaatgtgctgtccgtggtccaccgcaacaagccggagggctgcgagtgcgagaccatgcactttgtcactatggacgagctgctctcccagtccgacatcgtcgtcctctgtgcccccagtggcgacaagcccctggtggatgcggagtcccttgcgaagatgaaggatggcgtggtgatcatcaacgtctcccggggtgccaacgtgaacgaggccgccctgctggacgctctgaactccggcaaggtcaaggccgccggtctggacgtgtggctgagcgagaaggatcccaactgggccctggcctcccacccggctgtctcctgcacgccccacatcggcgcaggcaccaaagaagctcagaaacgcatcggcgcggaattggtggacattgtagagaacttcggctgatcagcattcccggtcaaacgcccctcccgttttcacgggaggggcgtttttctgtgccgtctttccgattttttctttttccgtaaattgttcctatatttttataattttttaactgccatctctatttacttttcaaagttggcagtgtataataggggccatacaatcgcagaacagaaggtgatggcttgaggcaggcagttgtcccgtcccagtatctgcagatcgctttggatctggctacccgcatcgcccaaggtgagttgacggagggcagccggatttacggtcggtcggtgctggcgtcggagtacggggtatccccggagacgatccgcaaggccctacggctgctggcggacatgaaggtggtggatgtgaagccccagagcggggccgtagtcctctccgccgacagcgcccgccggtacatcgaaaacttctccgaggatgcggacatccattccctgcgcctccagctgaaggcgctgctggcggagtccgccgaggtgaaccggcgcatggcggacaccgtgtcggccctggtaaaagggcaggacacatttgctgcggccggtcagcccctccccaactatgaggtccctgtccccaaggactctcctctcatcggcaagagcatcggggagctgaaattctggcagtccaccggcggcaccatcgtggccatccggcggggccagacggtgatcctctcccccggtccctatgccgaactgtacagcggcgacgtcatcatcctggtgggaagccccagcgccgcagaggccgcccaccggctagtaacgacaaaggagtgaaggcagcgatatgatccagtttgaacacgtctccaagagctatggcaagaccccggtcctcaaggacctgaatttcaccattccagacggacagttcgtggtcctgatcggcccttccggctgcggcaagaccaccaccatgaagatgatcaaccgcctgctggagcccgattccggcaccatccgcatcgacgggcaggatatccactcccaggacaaggtggagctgcggcggcatatcggctatgtgatccagcagatcggcctgttccccaacatgaccgtggcccagaacatctgcgtggtccccaagctgctgaagtacgacaaggcccggtgcgatgagatcgtccaggagatgctgcagctggtccacatggagcagtctgccaacaagtatccttccgagctctccggcggccagcagcagcgcatcggcgtgctgcgggccctggcagcttctccccccatcgtgctgatggatgagcccttctccgctctcgatcccttgactcgcgagtccctgcaggatgaggtgaagaacctgcagcagaagctgaacaagaccatcgtcttcgtcagccacgacatgagcgaggcgctgaagctggcggacatcatcatcttcatggccgccggagaaatcgtccagatggcctcccccgaggagatgctggagcaccccgccaacgatctggtccgcacctttatgggcaagcacacgccggacaccgccccctccaaagtagagagcttcatgcgcaccaatgtgttcagcgtccggaaggatcgcggcgtgttggagtgcgccgagcgcatggcccgaggcagcgtggacaccctgctggtcacagacgagcagaaccggtacttaggcaccatctccatcggcgacatccgccactggggccgggaactcaccagcatcgagcctctgatccgccagactgcccggaccgtccgggtgggggacgaggccaaggagagcttcgactacctgctggactccggtgccaactacgtggtggtgctgaatgcggacgacaccatcgccggtatcgtcaccaagaccagcgtggcccgcagcgtggcggagaatctgtggggtgattccaaatgatgacgctgatccaggactacggcgccgacctgctgcgggccatcggactgcacacgatatatgtgctgatctcggtggtcatcggctttgcggcgggactggtgttcggcatcctcctctcccgaatcccgcggtggctgtcgggcatcatcatccccattctctccatcttccagaccattcccggcctggtgttcatcggcgtgctgttcatctggtgggggaatatctatcccacggtgatcgtggccctcagtgtgtacgccatgttcccagtgctgaaaaacacctacaccggcattctggaggtagagccgaaatacatcgaggccgccaagggctgtggcatgtcctccttccagacgctggtgcgggtggagctgcccctggccatgccggtcatcatctcggggctgcggatggccgccatctacaccgtctcctgggcggtgctggcctccatgatcggcctgggcggcctgggcgactttgtgtaccggggcaccagctccaacaacaacacgctgattctcctgggggccatcccggcggccatactggccgttctcttcggactggtcattgacctgctgcagaaaagggtcacgccccgcggcctgcgaaaggaggcgggcaaatgagctgggacctgatttttcaacatctcttcatcgttctggcggccagcctgctgtccatcgccgtgggactgcccttgggcatctgggcatacgtctccaagaccgcccggcccgtcatcctgcggattgtggacctgctgcagaccattccctccctggcccttctgggcatcatcatggtggtgctggaccccggcaagctgacggtcatcaccggcatcacgctgtactccctgctgcccatcgtgcggaacacctgcttgggactccaggaggtggacccgggtgtgaaggaagccgcccggggcatgggcatgagcaagccctaccgggtgctgatggtggagttccccctggccttccccacggtgttcaccggcatccgcatcgcggtggtaaacgccatcggcactgcggtattcgcagctttcgtgggcggcggcggtctgggcggcgtcatcacccaggccatccggatctccgatatgtccctgattctggcggccaccggcgtccttatggtcatcgccgtggtgctggacctcatcatgagctggttcgaggggcagatgcgcaagagccggggcggctccaagaaaatgtggatcccggtggcggccatcgtactggcgttcatcctgctgctgccctatggccgcggcggcaccggcgacattcttctctatgacggcgactactccgaaacccagctgatgcaccacatggtaaagatgctggtggaggaccagacggacctgaccgtcaccattcaggatcagatgtcccaggtgaacaactggaactccctgaaggatgacagccacacctgcgacctgatgatctcctacgacggcacgatcctcaccacctttctgggccaggacacggtggacgttccggagggcatgacgatctacgactacgtccagggcgagctggacagctacggcctcacccagctggagcagctgggctttgaaaacacctacgccatcggcgtgccccaggccctggcggacgagtacggcctggagaccatcagcgacctcatccccattgcggaccagctgaccttcggcgcggagcaggagttcttcaccctggagggcagcatgaagtatgacccctttgtgaagttctacggtctgaatttccaggacgcggtctctgtggatatgggcctgaagtactccgccattgaaaacggcagcttcgatgtggcggtggtctactccaccgacggcctgaacaaaaaggtcgggctgaaggtcctggaggacgaccagagcttcttccccgactacaacggcgtctttctggtgcgggacgatctgctggagaagtacccggaggtggcggacattctgaaccaactggcgggcaagatccccaccgagcagatggcggagctgacctaccaggtggacgtggagggccgcactgtggatgaggtggcccgggagttcctggtgagcctggggctgctggaggcctgatccccgctctctttcaaaaccgctctggagcgtccgcgctccagagcggtttcctttggaaaatttccacttctttgcaaccggcatcacgttttctcgtctatgttggtgagagaacctccagccgtgggctggagacaggaggaggatcccatgaatctgcaaaagcggtacttattgatgggcggagccgtgctggccatcctgctgacgctggcggcaggactgctgttctggggccggaggcccttccggggtctggaggcggcggacatcgccgcagccaccgtcctggtggcccccccggatgtgacactggagctggatgccggggagatcgagaccctggcggatctgctggcagatgtccgcatcacgcggccggaccagtcctattcggagtatgccggacagaccgtcctgttcacggtgaccatggctgacggcacagctgcgaacgtcacggcctacaacccgtttctgattatcgacggcaccggctggcgcaccgcctatgcgccctgcgaggcgctgaaccgctttgccaacgagctgctgcgggagagaggaggataacatggaggacacggagatcatcgacctgtactggcagcgggatcagcgggctattgacgagacccacggcaaatacggcggcttcctggcggggattgcctggaacatcctccgcagtcacagcgacgcggaggagtgcgtcaacgacacgtatctgcgcacctggaacgccattcctccggcccgcccctccgccttccgggcctggctggggcgcatcgtccgcaacctctctctggaccgctggaagcagagccgcaccgccaaacggggcggggacggcatggaggtgctgttgggggagctggatgactgtgtgccggagccccacggaaccgagaagacgatggaggaccaggaaatcgcgtcgctcatcagcgcgtttctgcggcggcagagtccggagagccgcatcatcttcctgcggcggtactggtacgggcagagcgtggcggatattgccgccggaatgaactgcggagaggggaaggtcaagtcctctctcttccgcacccggaaggccctgcggacctatctggaacaggaggaggtgtttttgtgaaagcggagcggttgtttcaaatcctgggtctggtggacgaaagcctcatagaggaggcggacaccgcctcctcccccgccgctgtacagcggcggccctcatgggttcggcttttggccgcggccgcatgtctcgcggtgatctgcgccggggcgtggggactgtggcaatcgaatctgggagcgggcaccggcagccccggagatgccgcgctggccggtggagaatccggcggtgacggccacagcccgggcactaccttcctgtcctacgccgggccggtctttccgctgaccacggcggaaacgaacacccgcctgaccgcagggcggaccgtcacctgggattttgcccccggctcctatgaggatggatccccccgacagtggggggcccaggtgacagacagctacacgctgaccaatcctgctgacggcagtgtgacggtcaacgccctctaccccgtctccaccagctggctggactttcccgagctgaacgctgctgtcaccgtggatagcggggggaccggtttctctgtgctctccggcggctacgccggaggctttcaggacgccggggagccggacggctccacctggaacctggccccgccggacgaatgggccgattatcaggcacttctggcagacggagaatacctgtcccgggcgatggaggaaactgctgccccggaggtcccggtgactgtatatcagttcacggatttcgccgcgccccatgaggaatacaacgccgctacccaggcggtgaccttcactaccgacccagaggccaccacagtcctctcctacggcttcaacggcatgagtcgggatgcggaccggggctggtgccagtacagctatttcgttcccgacggtgtccggagagagacggaaacaaaaattctgatcgtcctgggtgatgacatcggcgattatgtcctccaggggtatgccgacggcggctgtgaccaggagatcgatggggtgtcctgcaccgtcacccgccgggagaccaccttggccgatgtgctggacctgctgtgccgggcttatcaggcggaatttgagcagttcagcctgggccgcgggcaggaaagccccttccggtatctctctcaggcgcagtaccagggattggtgtggcagctgctggagcagtacggcctcttctccggcacccccaaggaccggtacagcgacggccggctggatgagatcctgatggaagccctgtcccaggagcgggtgctgtacctgtccttccccgtcaccgtcccggcaggcggcagtgttactgtggcggcttctttttggaaggcacccagctatgactacggctgctctggttcggagaacgtgggcctccagggctatgatctggtgacggccctgggatccacgctggagttcaccggccagaccgccgccctggtgaacacggacaccattgagatcgtccggcagaacctgggctttgatctggaaaacggtgttacccaggtatcgctggatctggcggagcctcactactatctggaaatccgtcctctggagggataatcacaaagacgcgcctatggaagttccacaggcgcgtctttggcatcgttcacttcttccggccccgtatccaggccgccagaagcagccccgggagggaggccgcgaggactcccagctccaggatctcctgaccccctgtgcgttcagcaggggactcttcctgaacgggcagcgaatctggtcccatctccgcatcagccgcatcggcctgccgtgcctcccaagcttcaagggaggccgatttcaacacagcaggcggcggggcatccgctgcccaggccggggacggggagggcatccggacctggtccagcagcttttccggcgcagcggggctccggtccggtgacgtctcccactccgggagaaacccggcgctggggaactgccacagggagccgtccgccaacaccgccagggtccggtcgctgcaggggacggcacaaaccacaccgttcgtgatccgcacaatgccgtcacaggcctccgtgtcataggggtcctccgggtccaccagaccgtcccgcagcatggccgggcggtcgctgccccaggcccagagagttccgtccgccgtcacagcggtacatctggtgaactgcaccacatcctccagcagtttttccggctggcccagggactgccactggactgtatccgacagattattctcccagggcacacgccagagactgccatcctacccctggactagcatggcagggtcctgaattccgcagtacagactgcccacagcggccacatgttccatcaaaggtgccgcggtacaggtatccccgtcaaaccagacccgcaccagcgtcccatcctccttcaccgccaaatccccaaacagctgaaccacctggtccagtacctgggtgggcggatagtagggatcatcctgatgttcctccagggacactccggaccgggcgccccaggtccacaccgtcccgtcagcgcacagggcagaacattccgtctccccgactgacacggacaccacgtcctccagcagccggtacggctcctcctcgccgaaggtccggcccgcgtggccgccccagccccagagggtcccatcctcgtcaatggcggcggccgtgataaaccccgcgtccacataccgggcattctccagcaggacattggcctcctcccagggcagcgggtcctggtccgtggggcccaccgcgccgtggaagctgtctccccaggccagcagggcgccgtccgctcggatggcatagtaagtgtatccgctggtggcaatgggttggctgattgattccagcgccgccgctgtaccggccagcagcatggccgaaagaagcccgcaggcaagtattttcatatccgccgcctcctttttcccactgtaccatacagcctatccaaaaagcaaaccccgcaccgtcccggcgcggggcttgtcctttatttctcgatcttcacaaatttctccgccggggcgtgacacaaggggcagcggaaatccggcggcagggattctccctcatagacataaccgcagacagtgcagcggtagccgttgatctctaccgtgcggtacacggtggcagtgggcggcgtggccttgccccggtccgtataggcctggagggtcagcaccctcccgtctcccaacacctccgcctctgtggcctggcccacgaaaaggaggaagctgccgatctccatctggtccaccaccttgcatgcgatgcgggagaccatgtgctccttcaggtatggattgccgttgctgtcggtctccgccgcccggccggcgaacttgtccgtcacccggccggacttgtagccgaacaggtcgatgatctcccccggcgcgtccgcacccaacagggtaacggagaagctccccgccgcctgaatggccttgcaggtctcgtggtccttgttcaccgccacggtgaacttgggcgggaaggaagaggtcacctggtggaaggagttgacgatgcagccgtggcgcttgccgtccgctgccgcagagagcagacaaagggcgtagtccatcttctgatatgccttgttgtccatattgatttcctttctggcggatccgccgccggacatcccgcatgtttctcttgatggaataagtttaccagaagccgccattttatgcagttgcatccgcgactgctgccgcgcaaaaattttcttccgttttctgtggacaaataccggatttgggcgtatactctccttaaccagatgccattatcctgatttatattttctataagtctggataatggcttaaaatctaaataaaaggagtggttctatgtctgagagctacgctggcaagatcaaccggaagctgctgaaaaagcgccgcatcatcaacgccgccgccgggcgggagccgtcggacctggtgctgaagaacgccacctatgtcaacgtcttctccaacgagctctgtcatgcggacatcgccgtggcagaggggctgatcgtgggcatgggccaatactccggcacggtagaggaggactgcacgggtaaaatcgtcctgcccggctttctggatgcccacatccatctggagagctccctggtctctcccaaggagttcgtgaaggccgtgctgccccacggcaccaccaccgtcatcaccgacccccatgagatcgcaaacgtcatgggtaccgacggcatcgagtacatgctccaggccacggagggcctgccggtggacgtgcggtttatgctgccctcctgtgtgccggccacgcccctggacgagtccggcgcgtccctggactaccgggccatcgactccttctatgaccacccccgggtccagggactggcggagatgatgaatttcgtaggcatcatcgccggggacgaccagccggtggagaagatcgtggccgcccaggcccaccacaagaagatcgacggccacgcgccggatctggtgggcaacgacctgaacgcctacatcgccgccggcgtctattccgaccacgagtgccacgacctgaacgacgccatcgccaagctggagcgggggcagtttatcatgatccgggagggcactgccgcccggaacctggacgcccttgcccccctgctgtgcgacaaatactccgagcgatgcatgttctgcaccgacgacaagcaccccaacgacctgctggagaagggccatatcgactacatcgtcaagcgggccatcggcctgggggtggagcccatcaccgccgtgaaggtggcctgccacaacgccgcccggtacttcctgctgaacaaccggggcgccatcgccccgggctacctgggggacttcgtcatcatcgacagcttccaggacttcaacatcgagagagtcttcaagaagggcgagctgatggtggaccacggcgtggtgaaggacttccccgccccggccatcgacccctatctcaccgaacgggcccacagcaccttccatgtggagcacctgacggcggaggactttacggatgcccggccccggggcatcatcggcatggtgaacggggagatcaccacggtggacgccggctactccgaccggatcgacgtggagtatgacgtgctgaagattgccgtggtggagcgccacaagaacacccatcatatcggcatcggctttctccagggctacggtctgaaatccggcgctgtggccacatccgtctcccacgactcccacaacattatcgtggtgggcaccagcgaggacgactgcgccgccgcagccaaccgggtggtggagctgaacggtggcatcgtagtctgggaccagggcaagtcggtggcagaagtccctctggccatcgcaggcatcatgagcgatgagtccctgacatctgtcaacgaaaagctggaattcgccaaggcaaaggcccacgagctgggcgtcaatccgggcattgaccccttcatgaccctgagcttcatggccctgccggtaatcccctccctgcggatcaccacccgcggcgtgttcgatgtcaccacgcagagctacgtgtgaggagagcgaatatgctggaatttcttctgggggcatgctttttcctgtgcatttttgcccccttcacctttgtgatctttctgatcgacgccatcaagaaagttgtctccggcgatggaaacgagtatttccccggtctgggcgccgggctaagcctgtttatcatgctgggcgggatcttctatgtgcttttatgaatgcgcaaaattagcactctcgataccagagtgctaaaattcacagatcgttcaaacaaatgacacacaatatccgattttccatcctatcataatacttgaaaagaagaacagaaggtctttgaaaggcacctgttccgcccggcggcatcaccctccatgatccatctgccgtcggtcccaactacggatcatcaggatttgataggaggaattgattatgtttgaaatgagaccttaccgcagaaattctatgagcacctggaatcccttctccgagatggaggagatggagcgtcgccttttcaacaacgacttcttctccggccgcggtctggcggagttcaaaaccgacatcaccgatgaaggcgactactacgagctgaaggccgacctgcccggcttcaagaaggaggacatccagctgcagctggacggcgacaccctcaccatccaggcccaacgtcactccgaacatgaagagcaggagaaaaaggggaagtacgtgtgctgtgagcgttcctacggcgcgtacagccggagcttcgacgtctccggcatccgggcggagggtattaccgcctcctacgacagcggtgtgctgacactgaagctgcccaagaagacagtggaggtttcctccagccggcagatcagcattgactaaaatcaaagcaggaaaagacccgcggtgtacgccgcgggtcctttgctgtcccttttccgtcatatctccgcctcttccaagggcaggaaggaccggaagagataccggccgtcctccgccgcctccagtgtcagctctttgcctcctccagtgaggactagtagcttcccctcccaccggccggcctcgcagatgaacatgccggggccggcgtcgctggtgaagttgtagaaggcgtcggtctccggcaagtacaccagctccccggagctctccggcacattcgtcaggtctgccgtggtgatgtcggcgtgctcctccaggtacgcgtccagctccgtccgccggtaccggtggatgggcaccggcatccggtccagggagtccaccccctggaagggccagcccccggcccccttcagggcctggaactcagcctcgtcctccaccgtgcccccgatccccatgtagcgcagaaactccaccaggtccaggtcctccggccgctcatagtaagaggtgaagaagctgcagacggaattgacgtatgagacgttctcccgctccttaaaaggcgcgaaggcctcgttcacctgggcgatctccttcaccgtcagggcgtcggcggcctccggtgtctccacctgttccgtctccgaaaaatcggccccgccgtcctccggtgccgttcccgccttgccgcagccggtcagcagcagggccagtagcagcgccccgacgcaggcgaatcggcatctacgcatacgatcccccccctttttctcagcaaaccgcaaaaaatccgggaaatcatcgcaaaacagccacaaattccgttgaaatcattacaagggcaacgcctcatgttccacggtgatctggcagctcttcatggccgcaagcgcggtccgatggctctccggggtgacacctgcgcagcaggcggcatccaccgctacctctgcctccggcaggaacgccttcaccagcaaggcgttggaaatcacgcagatgtcggtgcagaggccgatcagcgtcaccttttcaatgagttccttttcattctcctccgccagcagacgccccagctccgcgctgccgaaggagggcttgtccagaatggcctgtcctgcgctggcaggccggagctgctcgacgatctcccagccctcggtcccccggatgcagtggggtacaggcaggttccgcccctcccgggtatggagatagtccgccccatgggtgtcccgggtgaagaaaatccgctccccccggcggatgcctgcggccacccgctccgccgcagcaggcacgatccgccgcgcctccggtgtccccagagcgccggacacaaagtcgttctgcatatccacaacgatcaggatgttcattatgatctcctcctttttatcatcatagcagacgccgcgccgggccgcaagaccttccccgggggaaaagaatgttgacttctcttttcatccggtttaagatatggaatgtctgtccgccgaatttttcggcgaatgtgaaaaagagaaggagagagaagtttgagtcgcgaaaatttccgatcccggctgggattcattctggtaagcgccggctgcgccatcggcatcggcaatgtgtggaaattcccctacgtcaccggtgtcaacggcggcggcgtattcgtgttgttctacatcatctccctggtcatcatgggggttcccattctgaccatggagctggcggtgggccgtgccagccgcaagagcgccgtgctgggctacaaggccctggagcccaagggcagccgctggcacatccacggctggctgtgcgtaatcgggtgctgcctgctgatgatgtactacaccacggtctccggctggatgctgggttactgcttcaagttcgcctccggcaccttcagcggcatgcagccctctgatgtagacacagtctggaccgatatgctggccaatcccggcgagatgacgctctatatggtaatcatcgtgctggcgggcttcatcgtgtgcagcttcggtctgcagaaggggctggagcggatcagcaagtggatgatgatctgcctgctggcactgatcgtcattctggccatcaacagcctgaccctggacggcgctatggagggcgtgaaattctatctggtgccggactttgagcgggccgcggaggtcggcatcggcaatgtgatcgtggccgccatgaaccagtccttctttaccctgagcctgggcatcgccgccatggaaatcttcggcagctatatgtccgacgccaaccgcctgcccggcgaggccgtgcggatctgctgcctggacacctttgtggccttgatgtccggcatgatcatcttccccgcctgcttcagctttggtctggaacccggccagggaccatccctgatttttatgaccctgccacgggtgttcgtcagcatgaccggcggccggctgtggggcgccctgttcttcctgttcctgaccttcgccagcttcaccacggtgctggcggtgttcgagaacattatggccagctgcatggacaacttcggctggtcccggaaaaaagccaccatcgtctgcggaatcttcatcctcttggccagcatgccctgtgtgctgggttacaatctctggtatttcgaggcgtccctgcccagcggcgccaccggccagatcctggatatcgaggacttcctggtgagcaatctgctgctgcccatcggctccctgatctatctgctgttctgcgtcagcaagtggggctggggctttgacaagtatctggcggaagccaacaagggcaccggcctggggatgtcccccaggttcaagatctacttccagttcatcctgcccatgctgattctggtgatcctgctggtggggctgggcagctggggctggcgtgcccttatctgcgccgctgtggccgtgttcgtgtggttcatggcccgccgcagctcctccaaatccaccatttgagcgaagtgacctgtcaaaagagaggaccgtcaaagacggtcctctcttttgcatctcacggcagcttcgcctggaacagcccgtggcaggagcagcaaaggtacagcttcgccccgccccgcagctgggggatgcggaactcgctgccctgttccggatacagccgcgccagcagcagccggtccggtgtcacacaagcggtaaagcggatatagtgccccttgtccatggggtggcggaaggtgacataccagtcctcctccacctcctggaccgttacggcgtgatccggatctgcggaccggacctccaggggctccagccgccggccgcagcaggcaagctgccctcccgccgcagctgtcagaatgttgccgcagtccgggcacacgtaaaactgtatttttttcatatttcctccatccggcgccgccggaagcaggtctccgtccagaattccctccacgctgacgccaaaaatcttcgcaaggcgcggcagcatccccacgtccgggcagccctggccccgctcccacttgctgacggcctgagcgctgacgcccagcagttccgccgcctgccgctgggtccacccccgctccaggcgcaggcgccggagcagcgtcccggtgtcttggtcatgcatctcttctcacctctcccacaggatacccgaaattccgctggaacgcaagcaacgctccgttgagttcgtatggctctgcaaaatgtcgccgcttcgcttctcctagggctgttttcttggcgactcctccgaatttgcaggaagcggggctttttcctgcaaaatgacttttcatccggacggcgatatggtatattgggtgggagaaacacggctcccccgtgacacacaggaggtctcttgatatgataacacttcataacaacggcgtgttcctggcgggcggcgtccccgctgctgccggcccggtctctccggaggaggggcggaaacggaccatggcctggtccattctccaggcccacaacatctccggcgatccggagcacctgcagatccgctttgacgccatggtgtcccacgacatcacctatgtgggcattatccagcaggcccgggcctccggcatgaaggagtttcccatcccctatgcgcttaccaactgccacaacagcctgtgtgccgtgggcggcactatcaatgaggatgaccatgtcttcggcctctctgccgcgaaaaagtacggcggtatctacgtgcctgccaaccagtccgtcatccactcctatgcaagagagcagatggcgaagggcggcaccatgatcctgggctccgattcccatacccggtacggggctctcggcaccatggccgtgggtgagggcggcccggagctggccaagcaactgctgaagaacacctgggacatcaactatcccaaggtggtgctggtgtacctcaccggcgcgccccgccggggcgtggggccccacgacgtggccattgccctggtgaaggccacctttgcaagcggcttcgtcaataactgcgttttggagttctgcggccccggtattgcagctctccccatcgactaccgcaatggcatcgacgtgatgaccaccgagaccacctgcctctcctccatttgggagacggacggcgtgacggagggcttctaccgcgcccaccagcggccggaggattaccgggagctgcacccggcggacggagcctactacgacaagtacatcgagatcgacctctccaaggtcgagcccatgatcgccctgcccttccacccatccaatgcctggaccatccatgagtttctggagaatgccgccgacatcctggcggctgtggaggcggacgcccagaagcggtatcctaaggcccatgtgaagctcacggacaaaatccgtgacggcggcgtctgggcggatcagggtgtcatcgccggatgcgccggcggcctcttcgacaacattaccgaggcggcggacatcctccggggcggctccaccggcaacggtgccttcactctggacatataccccaccagtgtccccgtcagtctggagctgacgaagatcggtgccacggcggacctgctggagaccggcgccgtcatcaagcccagtttctgcggcccctgcttcggcgcgggagacgtgcctgccaacaacggcttgagcctgcggcacaccacccggaacttccccaaccgggagggatccaagcccgcggagggccagttcgccggcgtgtgcctgatggacgcccgctccattgccgccacggcggccaacggcggccggatcaccgccgccacagacatcgattacacctccgtccaccacgactaccacttcgacaagggcgtctatgaccggcggctgtactacggcttcggcaaggcggatcccagcgtggagctggtgatgggccccaacatcacggactggccgaagatgcagcccctggcggaaaatctgctggtggagctggcggcggtgctccacgatcccgtcactaccaccgacgagctgatcccctccggcgagacctcctcctaccggtccaaccccctgcggctggcggagttcaccctgtcccgccgggagcctgcctacgtgggccgggccaaggccgtggcggagattgaggcggaacggctggggggggacgccccggagaagctcaccgccattctggacaaggtgggcgacggctccgcgctggtgaaaaccactcagttcggctcctgtgtctttgccaacaagcccggcgacggctccgcccgggaacaggcggcctcttgccagaaggtgctggggggctttgccaacatctgctatgagttcgccaccaagcggtatcgctccaactgcatcaactggggaatcctgcccttcacactggacgcgggcacgtcctttgactacgcccccggcgactgtgtgttcgtccccggcatccgccaggccattgagaacggcattgaggatatcccggctagggtcatcaggacggacggcgccgtagagggcctgatgctccatgtgaaaggcctgacggacgatgagaaggaaatcattctcgacggatgcctgatgaactattacgccaagcgtaattaaagaggggacttcctcccctcttcagatcccccatttgcctctgccgttgcagcattatgattcccggccctgtctgggccgtcaatcgtgccgctgtctcgaaacagcctcacttttccgccacgggcggcgttttggctgtttcccagtgacatcggtcactggaggcaccgcccagggcggctaggtcaaagcattttcggcaggcacagaaggggaattgccccggaggggcgagagaggcccctctggagggtgccctggcgaaaatgattcaaagtggtccggctgcgccgggctccgaaatttctaatgattggcgaggttgagaccatggataaaatcaagatgaccacccccctggtggagatggacggcgatgagatgacccgggttctgtgggcctggatcaaggaaaagctgatcctgcccttcgtggacctgaaaacggagtactatgacctgggcctgctccatcggaacgagacgcgggaccaggtgaccatcgacgccgccaacgccaccaagcgcctgggcgtggcggtgaagtgcgccaccatcacccccaaccgccagcggatggaggagtacccccagctgacggagatgtggaagagccccaacggcaccatccgggcgattttggacggcaccgccttccgggcgcccattgtcctgcccatgatccacccggttgtgaagaactgggaggcgcccatcaccatcgcccgccacgcctacggcgatatgtacaaggctgtggacatggtgaccgaggagccgggcaccgccaccctcaccttcaagggcgagagcggcgcggagaagaccctcaccgttcagacggtcagcggtcccgccgtgtggcagggccagcacaacacggagaagagcatccgtgcctttgcccgcagctgcttccagtacgccatcaatcagcggcaggacttgtggttctccaccaaggacaccatctccaaggtctacgacggagagttcaaacggatcttcgaggaggagtatgagaccacctacaaggtggagtttgaaaggctgggcctcacctacttctacacgctcatcgatgacgcggtggcgcgggtgatccgctctaggggcggcttcatctgggcgctgaaaaactacgacggcgacgtgatgagcgacatggtggccaccgccttcggcagtcttgccatgatgacctccgtgctggtatctccggacggcaccatggagttcgaggcgtcccacggcaccgtcacccggcactactacaagtacctgaagggggagaagacctccaccaaccccatcgccaccatcttcgcctggtccggcggtttgaagcggcggggcgagttggacggtctgccggagctggtgcagttcggccaagcgctggaggatgcctccctggagacgctgaaagacggcgtgatgacaaaagatctgctggggctggtagagcccggcttccaggcccgcggtgtggacagtgaggaatttttggacgagatcgccaagcggttggccgataaattgggataaaaggggactgctaaaagcccggacgtctgttcagcgtccgggctctttttgctcttttgcaaaatcattggttgtgcggccgtttcagaattgattggagaaaatcgggcggatggaatagtagtagccggacatcaacagcggcacataggcctcatccgtggcaatgatggtcccatcctccagccgaaggccaaaagattccatgctttccgtgatatacagcatccgctcgacaccgagagaaaggttatcccccggccggtagaacaggatgtcctgggcgtctgtccacatggcatcccaccggatgttcgcatggacaccctcccggcaggtagtttccacttcgtggatagcaaactgcccctcaaaagagcggtctcccagaattttcaccgaaccatctatggcaactgtcgtctccccggccgacaccccttccgcactatatacggtggccggcacttccaaagagatctcctgaaggaacaccccggcccggtccagaattgcaaagaggacaaagcccgccatcagcaaagcacaggtgccgcccagcacctgactccactttctccgggtccgctcctttgcctgccgggccagaaaggccagggcctgccggatcgtcggctccggctccggcactgtcccccgctccccccgcagcagatccagcacgcccagccccaaagtatccgccagaggctccagcagggagatgtccgggaacccggcgccccgctcccatttggagaccgcccggtccgacacatgcaaggccgcggccagctccttctgggtcatattctgttctttccgggctgctgcgatcagcgccccggtctttgtccgatccatacttcatcacctggggccagtatatcaaatccggcctgctcccacaacaaacgctgcgtggaaccgcccagattccgccgaggcgccgtgtctttcggcagggtctttccacctcacggctgctctccgcccaggtgttcccgcagcactcggatcacccgcttcatgccgtccgtcagatacttgctgcggtggcgcaccaggaaatagctcctgtgaaacccgccgtcctccacagccagctcccgaaggtccccccgctccaggtccgccaccaccagagaccggggcagcagcgtgatcccaagccccgcccgggcgcaggccagcagggcagcggtgctgacgctctccactaccggctgcgccgtggcgcctgctccctgcaggccggcatccacactgttccgggtgccgctgccccgctcccgcaacagcagccgctcttccgccagctccgccagagtcagggagttctttccctccagatagccgggggcgcacactgccgccagctcctcaccgcacaggggctccaccaggtagtggggcgagacggtgacattgtccactacggcaaaatccagttcgttctgcaggatcatccgctctgtctccctggagttgtgaatactggcccggaccgtgatctcaggcagcgcctctgccagatgcgccaggatacccgcaaggcgggtctcgcccagcgtcacgtggacgccgaagcggcaggccccctgggcgccgctctcccgcaggacctccaccgattcctgaaactgggacagcacggtgtccgcatactgccgcagcgtacgccctgcctctgtcagatagacccggcggttcatccgctcgaacagccgcacgttgtaaaacacctccagctcccggatggccaggctcaccgccggctgtgccatattcagctgctccgccgcccgggtgaagctctcctgggcgcagacggcggaaaagatctcgagatgccgcagcgtcacggcactcccccctattcataattatttcattatgttttttatcctatcatatagattgatgaatgtcacgaaaaagcgtacgctgggggagaaatccaagagcgcgaaaggagcggtttccatgcccacagatctgaccaaagcccgtcagctgttcgggactttttccaaaatcggcgccttcacctttggcggaggctacgccatgatccccctgatccagcgtgaggtgacggaacgccgccgctggctggaggaccgggacattctggacattgtcgccattgccgagtccacaccgggccccattgccatcaacaccgccaccttcgtaggatatcaggtatgcggcaccctcggcgccttctgcgccacgctgggcgtggtgctgccctccttcctggtgatctacgccgtctcctttgtgctgcggcagttctcggacctggcggtggtccaatacgccttcaacggcatccgggccggcgtattggccctgcttttgaaggcactgctgtccatgtaccggcagagccccaagggcgctgtttcctatgccgtcatggcgggtgcctttgtgctgacggccttctgcggcgtggatgcggtgctggtgatcctggccagcgcgacggtggggctgctctccgcccgcatggcgaaaaggagggctgtgtgatgctgtatctggagctgtttttgaccttcttcaagatcggcctgttcaccatcggcggcggttatgccatgctgccgctcatccaggcggatgtccaggccaagggctggatgacggcggaagaattggtgaacttcatcgccgtcagcgagagtacgccgggcccctttgcggtgaacgtctccacctatgtgggggcggagctggcgggcctgcccggcgccttctgcgccacgctgggggtggtgctgccctccttcctcataatcctgctggtggcccggttctacgccgccttccgctccagcgccatcgtcagcggcgccatgggcggactgcgtccggctgtgatcggcatgatcggcgccgcggtggtctcggtggggcagacggtgttcctgccggagggattggcggcggtgacggcgtatcccctggtctgctctctggccatcttcgccctgatggcggtcctgacccacaagaagctccatcccatcgtcatcatcctgctgtccgccctgctaggcatcgtcaccggctacctgcagccggcgtgactccggtccgtcgccccggaacggggcggcgggcttttttctttagccggacaaaagactttctaaaagcaggatttcccctcttgacttggagtgcgctccaagtgctatccttttcatagagggattccgcccaagggcgggccggggacttcccactgtggaggcacctcgtctcccggagaaggcagtatccccttcctaaatctgaaaaggagaaatcgtgatgatttacaaggactttcaggacctgaagctgtccgctctgggcatgggctgtatgcgcctgcctgtggtgggcggcaacgacgccgtggtggacgaggccgccgcggaggagatggtggattgcgccatggccaacggcgtcaactactacgacaccgcctgggggtatcacaacggcaactcagagattgccctgggtaaggccctggccaaacatccccgggaaaaattttacattgccgacaagttccccggttacgacctatccaacatgcccaaggtgcaggagatttttgaggagcagctgaaaaagtgccgggtggactattttgatttctatctcttccacaacgtctgtgagatgaacatcgacgcctatctggacccgcagtacggcatccacgactatctgatggagcagaagcggcgcggccgtatccgccacctaggcttctcctgccacgggaacctgcctgtgctgaagcggtttctggacgcctacggcaaggatatggagttctgtcagctgcagctgaactacatcgactggaccttccagaacggccgcgaaaaggtggagctgctggatagctggcacattcccgtctgggtcatggagcccctgcggggcggccgcctggcccgcctttccgacgaggaggccgcccccctgagggccatgcgccccgaggaacccatcccggcctgggccttccggtttctgcagtccattcccagcgtcaccatgattctctccggcatgtccgacctggagcaggtgaaggccaacatcgccactttccagatgggggttcccctcagcagcagggagatggaccgcctgctggcccaggcccagcgcatggtcagcaagaccgcccttccctgcaccgcctgccactactgcgtcagccactgtcctcaggggctggatatcccctccctgctggcgctgtacaacgagcatgccttcaccggcggcggcttcctggcccccatggccctctctgctctgccgcaggacaagtggcccagcgcctgcatcggctgccgcagctgcgaggcggtctgtcctcagcaactgaagatctccgaggccatggccgactttgcgtcccggctgtaaaatctgagacagaagcgcccccgccgggaactctccggcgggggtgctcgctctcacggagtcttgacggtgtccgggaatgcggcccggatggcctccggcagatgggcggggtccaactgttcccggccgcaccactccgcaaagcggtggaccgcctctttgtccggcgacagcccggggatgacggtcagcgccaccgtccgttccccctccagcttccggaccagaatgccatacacacaagaacagtctggtcggaagctgcggacgcgcaccggcgcataccggtagccggtcatgccgcctgccctccgggagcagagaaacgcatagaggtcacagccgtaaatctctgccatgcggacaaccatgtcgaacctgggctgcgcttttccccgctcatacttttgcagtgtccgtgtggaaattcccaggcgttccgcagccttttcctgggaaagtcccgccagtctccgctctctccaaaaggggctcttttcctggatgtgtcttttttttttgatatttttgcatagcaaaccctccttctacggaggattttacattatcttccaaatttttaacacgaataaaaattcacttttggaaaaaaattgccgaacaatgtcgaatttcgtcgatttacccaaagaaaatacaggccccgcatattcatacggggcctgtgctcagacaaatccttccagcttggcgatccggtactccagtacggcgaactgtcggcgggtcagcggctggtccaacatcaggtctccctccgcatttccctgcatgatgccgttttccgtcagccagtccacggcggccctggcttctgcctggtagtccgtctcttcttcggtctccacccaggggatgcccaaatactccagaattcccttggcctctgccaccgccagcttctggcggtagtcggcctgccccagcagggcagcctcctcccggttggtgtggaagccgttttccagcaggacggccggggcctttgtgtgcttcagcacatagagctccggatcgtacacaatcggcgtggatcgcacggcgatgcccgccgcccgcacctgctccaggatgtcctgagccgcccgctcccggtcgccgccggggccgtagagatagacgctccaccctttggcagaggaccagccgcccccagcggcggcattgctgtgaaggctgacgaacaggtccaggtccgggatgctgttggcgatctcacaccgtctggccaggcttactgccccgccgccagtacgggtcatggtcacggagacgccccggtctgtgagcagcttctccagccgcttccccaggtccagggtgaatacatgctcataataggtcccatccggactcttgttggccagattgcccgcgtcatgccctggatccaggcagatgtgcttttctcgttcgctcaaatgcgtttcccccctctgtacaggctcggggaacacagggctccccttccagtttagtggaagggcgcccgtcctgttcccccgccggggtcttttcggagcggggcgcatatcatggagcaaaatcatccgaaacagggaggggtccccatgcctgccgctctgattaaacgtctgagcaatcttctctgcgtcaaaagtattgtgacgctgatcctcaccgttgtatttgccgacctagccgtcaccggccgtatctccagccacgattttctgactgtcttctccgttgttatcgccttctatttcggcacgcagagcgaacgcctcagcggacagctggagaaagacaccggacagaaattgtcctgaccgtcatcccagggccacgtccagcaccatcatcacgctgaagcccgcagcaaaggccagcacaccgatgtgggagtggcgtccctgggacatctccggaatcatctcctccaccaccacataaagcatggcccctgcggcaaagcccagcagatacggcagggcgggcaccagcagctccgccgccaggatcgtcaccagggcgccgatgggctccacaacgccggatagcacgcctccggcgaaggcccggagcttcccctcgccctccgcccgcaggggcatggagacgatggctccctccgggaaattctggacagcgatgcccagggaaagcgccagcacgcccatagcagtgatctccgtgtcccctgccagatatccggcgcagaccacgcccaccgccatcccctccggaatgttgtggagcgttaccgccagcaccatcatggtggtccggcgcagccggctggaggggccctccggctgcgcgctgccccaatgcagatggggaatgatatggtccagcgccagcaggaacagaaagccgagccagaggcctgcggcggccggtgcaaaggaccactttcccagctcctccgaccgctcaatagccgggatcagcaggctccaaaccgacgccgccgtcatcacccctgccgcgaagcccgtcagccccttctgcaggccgtccgacatcgcctttttcataaagaacacgctcgccgcgcccagggaggtgcccaggaacgggagcaggagtccgtataatgcttccataatccatcctttctcatcttgtgtccggaatcagtatccatgcgttcagaataccggattcccgcaccggtgtcaaattcattttcccaccggatggcctttcacaaatccggaaaatcgctgccgctctggacagcagggagcaagtctgctatgcttgacacaggggacaggctgccggatggctccgtttcccctcatttcaggctcattttagcttttgggtgtaccatggtcccatcatcagagaaccatcccggaataggaggaacgccatgagggtctctcaccatgtaaaacggtcggtgtgcctgctgctctccctgcttctgctggcgcagggcatgaccctgggcgcagccgctgtgggcaccgattccgtcccggcggggacatccgttctggagcccgccgcataccccgacagtgaggttctggtcctgtatgaggacggcaggaccgaggtggtcgtctacgaggacgccgcctccctggaggaggggctgccgcagctggcccggcaggagggtgtggcgctggtccagcccaactacacatacacaagcaccgctctctccaccacagacccgctgctggcggagcagtgggccctgtataacgacggcagcttccaactggaggagcaggagaacccctatccggtcttcaatgatccctttgcactcccctccgccccgtggcagtggattgccccctggtggatgcagtccgatgcatccgccgggagcaccggaaccgtgcaggccgcggccggcgtggacatcggcgcggaggatgcctgggccctgtacgacggcggaagccgggatgtggtggtggccctggtggacaccggcatcgactacacccacgctgatctggagggccgcatctgggtgaacgaagacgagatccccggcaacggggtagacgacgacggaaacggctatatcgacgatgtctacggctggaatttctactccggcagcaatcaggtctatacgggcagtgaggacagccacggcacccacggcgcgggcaccatcgccgcccatgcggacaacggcatcgggatcgccggcatcgtccggagcgaccacgtcaaagtcatggcagtcaaggctctgggcgggtgggacggcagcggctccacggcgtccatcatccgggccattcagtacgcggaggccaacggagcccggatctgcaacctgagcctgggctcttccagaaacgaccccgcgctgtaccgcaccatcgcggcgtcggatatgctgttcgtagtggcagccggcaacgacggcgccgacctggagcttgcccccagctacccggccagctaccacttggataacctcattaccgtggcgaacctccgatacgacggtaacctggatcctacctccagctacggcgcctcctctgtggacctagccgcccccggcacccatattttaagcaccacccccgggaattcatacagttacatgacaggaacctccatggcggcgcctatggtcagtgctgcggcggccatgctctactcccagtttccggatgccacgctggccgacgtgaaggacatcctgctatcctccgtccaaaagctggacagcctcaccggcctgacggctaccggcgggatgctggacctgggtgccgccatggcatccggggccgcggcccagaaggggcggacctggacggagccggacctggcggcctataccgacagtccgcccattctctccctgtctctcttccagtggagggggcagcagtatctgaccgttcaagtccaggatccggacggcgacttccgctccgccgcttatgccgccgggacatacacggcagcgaatttccagggcggcgccgcggggacgcccctccccttgaatgcgtggggggccgccaccttgctggtgcgcaatggcggaccttataccttttacgcggtggacctggccggcaatgagacggtccgcacagtggatctgccccggagcccctgagggcggcccgccgccaactccatccccggtcaaaaggactccgcaggctgtgcctgcggagtcctttttcctgctccggaaaagcggcccctccatcagtccttcagaatgtcctccagttccctgtccatcgtcacggtcatgcgtggcagctcatgcagtcccttccccaagtcggctgtgccgtgtctggtgaccgcagtgaccgggaacagctcatgcacaaatgcctccgcgtccggctcggtaatgccgaagggataggcgaagaaggtgacgggctggcccacctcctgggcaatgcggtcatggctcttctgaatatcccccagcaccctggcctcaaaggcactgtccgactcctccggatccctttggatgccgttgatgccgcccgggtcaaagtttccgcccagatctcccagattgtggagcgaataggcatgggacccgatctctaccaggccggagtctgccatctcccggcacatatcccagctgaggaagttgtcagcggacacgtcctgcatatacaccataatagagaccacggctttcatctggtatgcctgaagcagcgggaagagcagctcgtagttgctccggtatccgtcgtcaaaggtgatgagaaggggtttttccggcagcggctctccccctgccaactcccgcggcagcacagtgtggtagccatgttccgtcagccagcgcaggtcctgttccatacggctcacggtgatggtcatatcgttgcacggctcaccgtcctccacgatatggtggtacatcagcaccgggagggcccggtccgccggaatgggcatctgccacactcccctggcatagagatagacggctcccgccgtgaagcagagcgccgctgcggcggccactcccaggattcccacccgaatttttttcatctgtctgtcatctcccatgtgttggcgctgcggcgtatacccttagaaaattcgcaaatattattttatcagattaagttaaaatgtcaattcattaaatgaaaagattatctttgctaggatgttttagggtgattacatgcctttggattatgctgcgattggtggccggctgcaggcgcggcgaaaggaactggggatcacacaggaggacgcggcggaacgggccggcattactgtggtctacctgtccaaaattgaaaacggacgggtgcatccgacgctggacctgctggacaggctctgctgtgttctggaatacgaccttgcccgagccttcaccggcgtccagacgacctctcccgactacggtcaggagcaggtgctgcggcttttcaacgcctgtgcgccgcgtgtcaagcctgttgttctgcatctgctggagcagctggcaaccttaacgtgagcagaagcgggaaaagtatgcaccatgtctgtcccgcaaaaaagcggcgccccggcggaatattccgccggggcgccgctctggttttttccaagtctgtgccggataccctccattccctgcggggtggcggcaagggaccagcctccgcacactggcggaggccggtgttgaagccgttatgtttcctcgtacagctcaatgatggcgtcatccagggtgatgaacgccagtcggaccgtatcgctgagggtctccggcccgaaaatcacctgctgggcctccttcagataggggtccatgttatccaccttgtaggccacgtggggctgtttggaaaggatctccgggaaccgggttccctcctcaaatttcaggtattcaatcttgtagtcgtaggcatccacgctctcattgacccagaagccgccccactcgttgtagaccatgttgggctttttgttcagcacggggatcccgatatgcatatactccgctgccatggaaaacctcctgtcagttatcctgggcggccaactcctgatagaactggaaggcctcccggtcagtaaatttctcgtgcacgatcttggccaccgcccggcacatggcggcgggatgctcactctggaagatgttgcggcccatgtccacgccccgggcgccgtcggagatggcccggtaggccatggtcagggcctcgtcctccggcagcttcttgccgccggcgatgacgatgggcacgggacaggcggccactaccttctcaaagtcatcgcagtagtaggtcttgacgaaggacgcccccagctctgccagcatccgggcggccagcaggaaatactgggtggtgcgggccatctccttgcccacggcggtgacgcccagaacagggatgccgtaccgttccccggcgtccacggcgcggcacagggtctccagggaccgggcctcgcccgccccgccgatgaagcactggatggccacggcggaggcattcatgcggatggcggcctccatatcggcacccacgccgttgccggtgctcatgtcgtcgatgagcacactggcgtcatgggtggcccggaggcagatggcattgtggaccgtgggggggatgcaggagcggatggcccccgggtggccatgagcacgtccgcgtaccggcacagaggggcgatggtcacgtccatgcgctccaggcccgcagtggcccccatgatatagccgtggtcaaaggccagcatcaccgtgttgccgctcttgggattgaacaggtgggagagccgattcttggctccccagtccccgtggcccaggcccttggcgaagaagccctgctccggggcaggcacgtccagatggtagtcgtgggcggtcttgtttccgattgcgtctggcatagcgcttactccttactgaacgccggggtgcggcagggggtgttccacagacggagcatctcctcgtcccacttggcgatgttcatctgaaagcctgcggcctcctggacggtgaggatctcacccaccatgctggccacgacctcgatgcccttggccttcaggaactccacagtgtccttgaacagcaccagcatctccatcatggtggtggcgccgcagccgttaatcatcacaaaggtcttgtccccgggcttcaggtccagggccttgcacagggcctcggccacggtggccacggtatccttggaggacatcatgggcacccggacgccgccgccctcgccgtgttggccggcgccgatctccatcaggtcggtctctcccaggtcgccgaaggacatgccgttctggggatgggtggcatcggtggacttgacggtgatggaggccatgttgtccgcgtaatgttgagcgatctccgctacctcctccagagtcttgccctcccgtgcggcggccgcggcgatgtggtacagcgccaccgcgccggccagcccccgcttgttgtcctcgccgttggggtcgtaccggatctcctcgccggtgaccacctgacgcacattgaggccggccttcctggccagcttcatggcctgcttgcccgccagctggtcgccggcgtagttcagggtcagcagcagcacgccgtggcccttgtccgccatcttcatggcatcaaacaccagctggccgttgggggcggcgaagatatcacccaccgcctggatgtccagcatacccttgcccacaaaaccggcctgggcgggctcatggccggagccgccgtaggtgacgatggtcacccggtcggcattggccagatccttactgatgaccaggtggccgtccacattcagaatgtccggataggccagacccaggcccaccagctcttcgtcggtgaccgtctccggcgcgttcatgaacttcttcattttcatacagcattcctccagtgatatttaagtggtgcattgccaatcccgctcctgcgggtggaacaacaggttattcccgggccagcccctggaagaaccaggacatggatacggcgcccgcgtccggggtgccgatggtcttggtcccgtaactcttggcccggccgaatttggagacatactgcttcgtagcctccgccccctgggcggcggcctgggccgcggcatcgaacagctcgtccgcgctgtctcctgtataggccgcgacggcttcgctggcggggatcagggcatccatcatagtcttgtcccccaccttggcgccggacatatcttccagctcctccagggccttggcgaagatggccttgaggcccgccacgtcgatctcctccccctctggggcctcctcctgcaagccgtccagccaggtgttccacagggggacggcgctgccgccgttcagggtcataacggccatggccgcgtcatccagcatggactggatcccccctcggcggcgtccactgcttcggagatagccccggcaatcttcgccatggtcaggccgtgatccgcgtccccaaatttggaatcgatctccgtcagctccgcctcagcggcggtcacagcggcgcaggcgtttttcaggcgcgccgcaaattcagctcttgtcatgtgatatcggccccctcttttgacaaaataaacaaattttggaagacatctttattctaacatagtcatttcgctttttcaaggcgcatcgcccctcttttctcccggccagcagggactctccgacggcctttccaccccgcccttcattgacggacagaattccctattttgtgtgttttgtatatggatttcccatggcgattcttgtaaaatacaattgttgaaaaatgcaacgataggagaatggtatgccgaatcggatcgagatgtttcgccgcctggagcgacagtattttcgggacaggcttggcaccctgggcctgcagcagctggacggcatgatcctgcacctgctggggcgggagggccacatgcggcaggaggacctggccgtccagctggcggtggacaagggggctgtggcccggagcctggcccgtctggaaaagcgcggcctggtggagcggcaggtgagcgcccggtgccgccgggagaagcatgtctctctgactcccgcgggggagggcgcatatcagggcgtccagcggattctggaggagtgggggcatgtcaaataccagggcttcacccctgaggagcgcgccctgaacgaggcgtttctgacccgcattgcggagaatgtgatcgaattttgtcgaggagagggaagtgaacatggttaagaatctgacggagggcagaccgctgaatctgctgtttttctttgccctgcccatggtggcgggcaatctgttccagcagctctacaatatggtggacaccgcggtggtgggaaaatttgtgggcgaagacgcagtggcggccgtgggctcctccttccccatcgtgtttttgtcggtggccgtggcctccggactgtccatgggctgtacggtggtggtgtcccagctgttcggtgccgggcgcatccatgagatgaagaccaccatctccaccgccatcatctctctgggcgtcctggggctcctcatcatgggcctgggaacgctgctggccggtcccctgctgcagctgctgggcacggacccggatatcatggccgactcccggacgtatctgcagatctatttcggcggcgcggtcttcctgttcctctacaacactctcaacggcatctataacgcccagggggacagcaagacgcccctgatcttcctgatgatctccagcctgacaaacatcgtgctggacctgctgttcgttatccgcttcggcatgggcgtggctggcgtggcgtgggccacgctgatcgcccagggcctctgcgccgtggcctccctgctggtgttgctccgccggatgcggcggatgccctgcgagccggaaaaacagggcgtgaagctgcccctcttccacatggtggcggtgaagcgtatcgcccagatcggcctgccctccatgctccagcagtctctggtgtccctctccatgatgatgatgcagggtctggtcaactccttcggcaaagtactggtggccggatacactgctgccacgaagatcgactccctggccatgctgcccaacatgaacatctccaacgccatgtccagcttcacggcccaaaacatcggtgcaggcaagtacgagcgggtcaaggagggcctgaaggcctgtctgctgatggtggcggtattctctctgctgatcaccgtcatcatcttcctcttcggaaaccagctgctatccctgttcctggacccgggggacgcctcgggcgccatgggctacggtctggcctatatgcacacagtctccctcttctatatcctgatgggcctgctgttcgtccccaacgggatgctgcggggcgcgggtgacatggcagccttcaccttcagctccatggccaacctgttctcccgggtgggcatcgcctacgcactggtgtatctcaccccgctgggggccaacgccatctggtggtccatccccgccggctggctgatcggcgcggcggtctccctgctccgggtcaagagtggaaagtggatgcgcaaggctgtggccgaccgctgaccctcgcaggcggtctatttcaggaatcgcaggtgctgtggatatgaacaggaaacagaatctggaggtctttgcgaagacacccgtccgaaaggccgtgctgctgcagatagtcccggccgtggccagtcagatggtcacgctggtctacaatctggcggacacctactttgtggggatgttgaacgccccccatgaaaccgcggccgtcactgtggcctatccctcctttctgatgctgaccgccatttccaacctcttcggcgtgggcggggccagcgccatcgcccgggccctgggccgtcaggacgaggagggcgcccggcggatcgccgctgtctctctggccggcggcctgctgtccgccctgctcttctccgcggtgttccgactgctggccgatcccgtgctgcacctgtgcggcgccaccgaggctacctatgctgctgcctacggatacgccaaatgggtcgtcatactgggcggccccttcaccattctcaacaccctcctggcgaatctggtccgggcggagggcggcgccggagccgccgccttcggggtctccttcggcggcgtcctgaatatcctgctggacccgctgttcgtcctgccccagttcctgggcctgggcgcggtgggcgcgggcatggccacggccctctccaacggggcggcggtggcctgttttgccgtctatctggtccgccgccggggcgccacctatttgaacctgctgccggcgaatctgcggtatgccgcccagtacctgcgccccattctggccatcggcttcccctccgccctgcagtatgcgctgacagtggtggccaccgctgcccaggccgactttgtatcccaataccccacagaggcggtggcggccctgggcatcgtaaaaaaactggaccagctgcccctgtatttctccatcggtgtctccaacggacttctgccgctgctggcctataaccacgctgccgggaatcaccatcggcgtgcgcaggccttccggatagggagcctgatgtcctttggcttcgccgtgctgtgtctggtctgctatgaggcgtttgccacccccctggtctccctgttcattgccgatgctgcgacagtccgctatggggccgtgttcctgcggtgcatggtgacggcaatgcccatgatggccctgtgctatcccatgatcatccagttccaggccatgggcagggccagggagtccctggtctgctcgatcctgcgcaagggtgtactggacattccgctgctctatctcatggacgcgctctttcccctgtacggctgtatgtgggtgcagcccatcgtggacgccatctcgctggccgcagccctgtggttttaccgggccatccaaagggggagcgcggcgggcggaacggccccagccggggcctgaaaccggcgtgagcaaaacggaactgtaaggaggagaacgaatccgtggcaagcaaggagcacgatttttccgtcggcagcattccccgcaacatcatttcgctggcgctgcccatgacggctgcccagctcatcaacgtgctgtacagcgtggtggaccgcatctacctggggcggctccccgggcatctggctctgacgggcctggggctgacgctgcccatcatctccatcgtgatgggctttgccaacctgtgcggcacggggggcgccccctgtgctccatctaccggggcaagggcgaggaggaagaggccgagcggatcatgggcaacgccttcacccttctgctgattttcggcgccgctgtcacaggggtgttcctgctgttccggcatcccctgctctacctgttcggcgccagtgacgccacctatccctatgccgaggcgtacatgaccatctatctgctggggaccgtctttgtcatgatcggcctggggatgaatcccttcatcacgtctcagggcttcggccgcaccgggatgatgaccgtgggcctgggggcggtggtcaacatcgtgctggatccggtcttcatcttcgccctggacatgggggtgcggggcgcggcgctggccaccgtaatcgcccagggctgctccgccgtgtgggtactgaaattcctcaccgggcggaaggccatcctgcggctccgcctgcggaatctggcgctgggcgccgggcgggtgaaatccatcgtggccctgggcctgtccggcttcttcatgaatctcaccaacagtctggtgcaggtggtgtgcaacgccacgctccaggcatacggcggcgacctgtacgtaggcgtgatgaccatcatcaactccctgcgggaggtgttcttcatgccggtgcaggggctcaccaacggcgcccagccggtcaccgggtacaactacggcgccggccgatacagccgcgtccggagctccatccgcttcagcgtggcggtgacggttggttacgccgctgtcttctgggccgccgccatgttgttccccgggcttttgatccgggtcttcaacagtgagccggaggtggtggctgccggcatccccgccctgcgcatttacttctgcctgtttatccccatgtccctccaaatggcggggcagggtgtgttcgtgagcctggggcgctccaagcaggcggttttcttctctctgctgcgcaaagccatcatcaatgcgccgctgacggtcgttctgcctatctggatgggcaccaccggcgtattcacagccgaggccatctcccagctggtaggcggcctggcctgcagcctcaccatgtatttcaccgtgtaccgtcccctgggccgcctgccggaccgcccgccggagaacatctgagacccggttgccgcgccgttgttccctctcttactcccacagactcgcaagaaaaagcggaggcgcttttggaggtttttccaaaagcgcctcctctgcctgttccggccccctgcgcgtcttgacaaacagttccggcccggctataatcttccccgcaagtcccggccgcccctctgcgggaggttggaagatcccgaacctgttaggagcaccgccatatcatgagagcatcctctgcatacagcctctttgatacagagagtgtctgggccatcctgatgcggatcgcgcctccggtcatgctggcccagctgatccaggccatgtacaacatcgtggacagctattttgtgggccagttctccagtgacggcctcaccgccctctccatcgtctaccctgttcaactgatcgtcaccgccatcgctgtcggcaccggcgtgggcgtcaataccctgatgtcccggtacgacggccaggggaaccaccacctagccgaccggaccgccggaacagggacggtcctggcgctgatcagttggctgatcttcgccgtattgagcggcctgctgatgcgcccctttgccgcgatctccacggagtcctcctccgtggcggaccttgccgtgacatacggtaccatcgtctgcgtgggcagtccgggtgtgtttctggagagtacctggagcaaggtccaccaagcccgcggcaacatgcgcctgcccatgttggcccagatcgccggcgccgcggccaatatcgtgctggacccgattctgatcttcggccttggcccggcaccggcgctgggagtggccggtgccgcctttgctacggtgtcaggccaggtgctggcggcgctcattgttgtctccggattccggaagccgccccccatccgggtgttccgctcctatgcggccaagatctaccggttgggatttccctccatcttcatgcagcttctgttcacggtctatatcatggccctgaacatgatcctggccggcttttccgatgacgccgtgacggtcctgggcctgtattacaaggtgcagtccttcttcttcatccccctctccggactccagacctgcatcgtccccctgctgagctatacatacgccaagggtgcctacggccgctgccgccgggtggtgaagaactccgtcctgctggccatgtccttcatgctggtggggatcgcctgcttcgagctgatcccggaacagctgctgcgcattttcaccgcggagcccgcggtcctggagatcggcgtccaagccttccacatcatcggcatcagctttctgcccgccgtgccctccctgatcctgccggtctttttccaggccatcggggcggcgctgcccagcgtcctgctctccctgaccaggcagatcttctgcctgattcccgtattctggctcttctccaggatcgatctggcctacacgtggctggcctttcccattgcggaagtcgtgaccggaacgctgggcctgtgcttctatctccaccgcatccacatctgggaccgctgcaagggcgcggccctgaaacccgaacgcaaaggagcgactgccatgaaactcatcaccgccatcgtcaacagacgggacaccagcgaggtctgcgccgccctgacagacgccggcttttacttcacccgcatggcctccaccggtggttttctcaccggcggcaactccacgctgctgatcggcacagaggaggaccgggtgccccaggccatcgccatcatccgccagaactgctcccgccggacggagaagatctcctccaacgtgcagctggccacgccctctgcggcctatcccacggaggtgaccgtaggcggtgccacgctgttcgtctccgatgtgacgcagtttgaaaagatctgagccgcccgccatatccggcggccgggcacaagcaggacgaagcgatccccctcagtgtgtgcactgagggggatcgctttttgcatcaagatcgatcaggcaggggcgaacgccgcgcccggagacgcggccacagtcccatcctcccgtacggccacatattcgatcatctcgccgctgtccctgcgcagccggtccaccagaacgccgccctcctcttcccccaggatgaaaaaggcagtggagagcaggtctgtgtaaacaggccgcgaggacaggatggagacgctcttcagtgtcagcggcatggggtacccggtccgcgggtccagcagatggtggtacacggtcccattcttctggaagctgtgctcataccaggaggatgtggcgatgcccgcgtcctggagctgcaccgtcccaaacaccgagccggtgttgtccgggtcccggatcgccaccttccacggccgggtcccgccctgcgcgtcctggtgcgcgccgatcacaaacaggttcccgccgtagtccagcacggcctgccggacgccgccctgccgcaggcggtccacggtcagacccagggcgaagcccttcccggctgcgcccggatccaaaccgattccagaaagatcaaacgtcacggtccgcgtattccggtccaggcggacgtgctgatagcccacccggtccagcaccgcccggatgcgctccgcagaggggatccggggcgtctgggacagaaaatcccacagctttaccaccggccccaccgtggggtcgaatgctccgctggacaggcggcagatctccaggttctgctccaggaaggtgtacagggtctcagagaccggcacagcctcgccgggccggatgtcccggcagagcctggaaagctctgagtcgggatcgaacatgctgagggtgcgctccagcccgtgggcctcctcctcgcactgctccagcagctgctccccgtcctccgggatttccgccgcgatgcggcagagggtgtcgtacgccaaaaatgcgcgggtatgctccataacggttttcctttccggttcttgtctttactggaaaacgccgtccttgcgcatctcctccaggacaaccttggccatccgcaggtagttgatgaacgcaggatacatcggccggttcttgggatccatatccagatgcgcatggtctgggttgggattgtcccagatcatgcccatatcccgtccggcggcgtggggcaggccggtcagatccagcatgttctgggtggcgcagaccttcaggttcaggttgtccatctgggtgcggaagcccaccaggaaggcgtggcggtcccagccggaggggaacggatcctcataggcggggcagtcgtatttggactggcggtagtactttttcagctcggggtggacgatgtcctcctcgttgtctgcgaagatctcgtcaaagcggcaggagcggatcctgccgttctccaccaccaccttcagccagccggtgaggccgtagccatagtcctcggaatagctgtacagcttcttggaggagggctcgtccagctccttgtccagcttggccgcgaaggtcagcagcttcttcacgctgccggaggcgctggccaccagatcgaagtctccgctcaggctctgtttctccagcatctgctgctccacgtactgcatacccatggtcagcacggagccggccttctgcatccggggcttcgtgtactgccagaagctgtagctggagcggcgcttggagatgccctggtacaggtggttgtaataggagggagccgtgatctcattgagctccacaaagatcagcttgccgtcggccttcaccgcctccacaatgcccaggtgacccggatcggcgggaaactccccctctacgccgggatagtagggcgggaaccgttcctcgatccgatagtagtcacccttcagcatccccttgggggctggacggaccagacgggcttctttcctgcgttatccatgttcgttcctccttacttcacggcaccgtccttgaccatctcgtcgtgaacgatcttggccaggcgcagatagttgttccacacgggagagcggggccgggtgacagaacgggcggtggcgtcgctgttggagacgagtgccacatcgtccttgtggggcttgtcccacaccacgcccatgtccgggccctccacgcagggcagtccggtgatatcgaacatatcctgtgtttcgcagaccttcttgttgatggcatcggactggtccttgaagcacaccagccaggcgtggcggtcccagccggaggggaacgggtcctcataggtagtggagaaatacttggactgacggtagaactgcttcaggtcgtcgtaaacaatatctttggtgtggtcggcgaagatctcatcgtagaagcacctaacgatcttgccgtcctccaccaccacctggagccagccggtgataccgtagccgtaatcctcggtgtagccgtagtaccgctgcttcttgtggttggagtccttccgctgagcggacacgtcgtccttcaggccgatcatgttcttcatggagaaggaggcaccggtcagtaggtcatagtcagcgtccaggtcctgcttttccaggatctggtcctccacatatttgaagccgttggccagcacccgcccataggccacgctgcggcgcttgtcatggaagtcctggaagaactggaactccgtgcggcgcttgctgacattctggaagtggcggacatagtagttgcccatggtagtctcgttgaactcggcgaaggcgatcttgccgtcgtcgtcaaacaccacgtccagctcgcccttgtggccggggtcgccccagcggccgctgtaccgcagctcggcgtgatagtaatcgcccttgaccaggcccttgtactggggctgcgccgtccagtcgatcagctcgctctcgttgtcctcatgccaggggcccagccccagccatctcgtcttgtcaatcatgtcaaattcctccttatgattctgtccgtcacttggacggggtttgctcttccagggcgccggcccggcagcaggcgcagaagtggccgctgccgaagtcccgcagcgccaggtcccggccggtgcagccctcccgggcgtacaggcagcgtttggcaaagcggcagcccggctccgggtcaatagggctttgaagttcgccgatgagcttcacccgctgcattttctgccggctgctggggatgggaatggcagacagcagagcctgggaatagggatgcagtggctggcggaacagctccgcggaatccgctgtctccaccaactggcccaggtacatcaccgcgatcttatcggagaagaacttcaccaccgacaagtcatgggtgataaagagataggtcaggtggaactccgcctgcagatccttcagcaggttcaggacctgggcctggatggacacgtccagcgaggacaccggctcgtcgcagacgatgaactggggctgcagggacagcgcccgggcgatgcccacccgctggcggcggccgccgtccagctcgtggggataggcgttgaacagccgggcggagaggcccaccacgtccatcagccgggagacctccttatccagctccgcacggctttgggcctttgcgtgaatccgcagcggttccccgatgatctccccaatggacatccgggggttcagggaggagaacgggtcctggaagatgatctgcagatccttgcgcaggtcgtgaagctgcttcttattcatcttgcagatgtcctgtccgttgaacaagatctcgccgctggtggactggtgcaggcccaagatcagccgtccgatggtggacttgccgcagccggactcccccaccaggcccagcgtctcgcctctccgaatggaaaagttgacgccgtccaccgcatgaagggtgccggtggggcttttgaaatacttcttcaggtcccggacttccaggatgatatccttatctgccatgtcgcacctcctccatcagttcgggggattcgaaaacgccctggtgggccaggcagcgcaccatctgggtgccgccgacgccggtcatctccggcttgcgggtacggcaggcccccgttgcgtaggggcaccggggtgcaaaggcgcagccctccggcagctccgtggggtccggcatctggccctggatgggcttgagcttctccgccgtctcatccagagacgggatggagccgaagaggccgatggtgtagggatgatgggggtggtcaaacacctccgcgatggtgccgctctctacgatctcaccggcatacatgatagccacccggtcgcagacctgggccacgacgcccaggtcgtgggtaatcagcagcagggaggtacggagcttttccttcagctcgttcatcagttccagcacctgggcctggatggtcacgtccagggcggtggtgggctcgtccgccagaatcagctccggcgagcaggcgatgctcatggcgatgaccacccgctgcttcatgccgccggaaaactggtggggatactcgtcatagcgggcccgggggatgcccaccatctccagcatatcgccggcctttctccggccctcctccttgctgcacttttcatgctggtggatgacctccgcgatctgatcgcccacggagtagaccgggttcaggctggtcatagggtcctggaaaatcaccgagatcttgctgccgcggatctcccgcagacgggcgggcttggcctggagcatatcctcgccctcgaaccagatctcgccgcccatgatctttcccggcgggtccgcgatgagccgcaggaccgacagggccgtggtggtcttgccggcgccggtctcgcccaccagacccaggctctcgccctttccgatggtcaggtccaggccgttgacggcgtagaccacgtcctcgtcggtgtggtactccacccgcaggccgcggatatccagcagggcctccggggcctgcgcggaggggatgggctccgtctctggcaaagcggtcttgtgctgcttgttctcttccatgtggcgtcctccctcctcagttcttcagcttggggtccagggcatcccgcaggccgtctcccagcaggttcagggagaggatggtcaacatgatggcaaagcccgggaacgcgcacacccaccaggccgcccggaaatactgccggccggtgctgaccatagaaccccactccggcgtgggcgggctgatgcccaggccgatgaagctgaggctggcgatagccaggatggacccggcgatagacagcgtggcctgcacaatgatgggggccatgcagttgggcaggatgtgcttgaggatgatgcgcttgtcgctggcgccgatggcgcgggccgcctcgatgtactcctcgttcttgatggtcagaacggcggagcggacgatccgggcaaagggcgggatgttggagatgctgatggccagcatcatattcgtgacgctggtgcccatggcggacaccagggcgatggacagcaggatgctggggatcgccaggaagatgtccatgacacgcatgatgacatcgtctacccggcggctgccgtaaccggcgatggcccccagcaggccgcccaccactgtggcaatggcgatggtggcaaaggccaccggcagggagatccgggcgccgtggacgatccgggccaggatgtcgcggcccacctcgtcggtgcccagccagtgctcgacggaggggggctggagcttcagggatgcgttctgctgaatcaccagcgtctcgtagtcaaaaaacacatcggcaaagacggcgaagaagatgatgacggccagaatgatgagtcccagaacggccatcttgtttttcttcaggcggcgccatactgcggcggcctgggactttttcttgttcttgtttttcactttcccagtcatccgcatcacctctttgccgttttgtactgggcccggattctagggtccaggaatgcgtacaggatatcaatgcacagattgatgatggtgaacatcgtggccagcaccaatacgcaggccaccaccacgggcgtgtccttcaggccgatgcagtccaccagcagccggccgatgccgggccaggagaacaccgtctccaccagcactgcgccgcccagagagaagccgaattgcagtcccactgtggtgacaatgggaatcatggcgttgcgcagagcgtggcggatggtgatgacgctctctttcaggccctttgcccgtgcggtgcggatgtagtcctgccggatcgtctccagcatggaggagcgggtcatgcgggtgatcatcgccagggagttggcgctgagggtgacggccggcagcaccagagcgccccaggtctcaaagttggaggatgggaaccaccccagccccgctgcgaagatcacgatcagcatcagccccagccagaagttcggcatggagacgccgaacagagcgcccaccatggaaatgttgtccaccgccgaatactgatgggtggcggagatcacgcccaggggaattccgatcagaatggcaaaaagcatggcgcaggccgacagcaggatggtattgggcagccgggcggcgatctccgccgccaccgggttgccggtgctgtatgaggtaccgaagtcaccgtggaccgcgttgatgataaaccggccgtactggaccaggaagggatcatccaggcccagctcctcctgcatggcggcgtaggattcctcggagtagttgtcgcccagcatcatctgcaccgggtcgccgggggtgaagctcaggatcgtataaacgatgaagctgacacccagcagcaccggaatcagcatgagcagccgtttgagaataaaacggtacatctgtcactctccttttccataacgcaaattcgcgcaagcggacggcggcttttgccgccgcccgctcactggaatgcctgaatgcgcttattcaaaataggtgccgttgatgtagtgggacttgcccggatacaggccgaatcccttcacattggactgcataccggcgttcaggtgctccaccgccatggggaccaggggcgcggcctccgccactttgctctggatctccgcatacagctccatggcgtgctcggtgtcggtggtggtgctggcctcatcgatcaaggcgtccacctcaggcgtggtccagaagcagcggttgccggagggccccagagcctccgtgtggtacatggaccgcagcatggagtcggggtcaatggaggtcttggacatgatgaacatatcatgggcgccgttgccggtctcagactggaactgtccgctctccagggtcttgacctcggcgttgatccccacctggcgcagctgctcctgaatgaccacggcggagtcccgcatcacctgggtatcggagcaccagagagtggtggagaagccgtcaggatagccggcctcggccagcagctccttggccttctccacgttgcaggagtagtcggagcagtcggagacgtagccgtccacactggggggcagcatggtgtagttggcgggtgtggcctcgccgctgaacaccaggtcgatgtagccctgggggtccagcgcgtaggcgacggcctgccggaccttctcgttgtcaaagggcgccttctgcacgttcatgcccacataccacacggtggtgctggggaggtgagggtggtgacggacgcgttgtccgccaggctctccaggtcggtgatgcccaggtcataggccaggtccacctcgccggtctccaggccaatggtgcggttcagcgcctcgggaatcgtgcggaagatgacgcgcttgacggccggagcgccgccccagtagtcctcaaaggcctccaggaccacgtcgccgcccagctcccaggagacgaacttgaaggggccggtgcccacggggttcttgttgaactcctccgcgctggtgtccgcgctcttgcagatgatggaggccgcgtccaggctcaggcggtacagcagcgcgttgaagggcgcggaggtcttgatggtgacggtgtagtcgtcatcacaggtgatgctctcgatgatgaggtagttgtaattcacgccggggtttgcgatgcagcgctccaggctgtacttgacatcctcggaggtcatctcctccccgttgtggaacttgacgccctggcgcagatggaacacggtggtggtatcgtcgataacctcccagctctccgccaggcccggcactaggttcatgtcgttgtccatcatcaccagacggtcaaacatctgggtggtgacacgataggtcccgatggaggcctgcaccatgggatccatgtaggtgggggactctgggatagcaacgatcagggtatccttggcgccatcgtcggaaccgtccgtggtcgtcgagctggaaccggtggggccacagccggccagcatcccgcagagcaggaacattgcggtgaacagtgcgaaaactctcttcttcatcgtactcctcctgacgtggtggtgatatatttctgaaaccgcccccggcggtcacattcctgattgtgtgctcagcgcaggccgtcggccgccagagcatcctccatccgcctcgccagctccagatagttgtcccattccttcgctcgcttgggctcctccgtgaaggggagcccggtcaggtcggtgaggctctgggtctccagcacccgggcgctgagcaggtcgaagatgctgttgaacccggccccgatggtggagatgtagtccgggcagtgatatttggactgccggtaatagggcttgagctccgggtcctcaatctcctcctgccggtcggcaaagatctcgtcgtaggcgcaggagatgatctttcccgcctccagcacgatctgcaagcgcccggtgacgccgggctccaccgcctgggacaggccgtaatacacctggccggagggcttgtccagccgccccgcgatctcctctgccagtgggagcatagaccgcttgatgctgttggaggcgccggtgagcaggtcaaactcgcctgtgaggcggttctccgccaccatctgctcttccagatgggtcaggccgtttaccagcaccacgccggacttggcggtccgctccttggtggcctgcagaaagccgtagtcggacagccgcttggaaacgccctggtaccgtctgatgtaataggtggggttgttaatctcgttaaactccaccatctgcagggttccgtcccgccggaccacttccagaatgccgtgataccccttgtcccccgggaaatgcggggcaaaccaattctcagcccggtaatagtctccctttaccagccccataggtggctgcaccgtccagaacagccggtccagcacgtcaacggacttttcgcgcttcttctcttccatgcctctcttcctttccctcattttgatccgcattccaccgccgggtgcggatcttgtattctttgaaaattggcgctataatgattgataaaatctgaacgcccctctgaccgggcgcctttgttttgcctgttacgattataacatgctcccctggctgtcggattataggggattttgttaagccttcgctatttgggattaggtccctccgccgttttgagaaagagagcgcgacatgaacacagaacacctcgtctatatcctggaggcgtacaagtgcggctccgtcaacaaagccgcccgaaactgctatatctcccagtcccatctcagcaccatcatcaagaacgtggaacaggagatcggctatcccctgtttcacaggacggccaacggcatcaccgctacgccggagggactgattttcatgagccacgctgagaagatcgtcaccgagcgcaataatatccagaagatcccgcaatccatgtccgagagcgacagcctctccatcatttgcgcccgctccgcctttgtgctccagtgtttctttgattacaaaaactgcttccccaacctgaacaggacccacgacaaatttctggaggccggcctccgggaaaatctgaaaaacgtcgtggcccagaactgcaggctgggcatcctggtgctgttcgagcaggtcatccccaagtacatggatctggcggaccagtacaatctggagatgacggtcctccagcgctccattcccgtcaccgcgctgatgtccaagtcccatccactggccaactcttcccgtgtctcgctcaaggatctcacagggtatccgttcatcgccgacgcgcacatcgatccggacgatacgctggacgtgctgggactccagagccacacagacctgctgtacatctgcgaccgcggcacgatcttcgacgcggtccgcaaaggcaattacatcgccatcggcatcagcattccggaggaggatgcccggcggatgaactgcgtctgctgtcccatcgcggacggcgctcccatggccgtggccctgctgcattcccggacatttacgctccgccccagagagaagcacttcattcgctatctgactgaccgcctgcacaagcgctattccggataaacggcgtgccgcctcccacagggcagtttgtccgcatcggcgtgtgtccctgttggtgcgatggctccaaacattgccgacagcgtgtgcaggaacgccttttgcacgcatcttgccgcaaagatttaaaaccccaggaactgctgcgcagcggtccctgggggttttaaatagcggctgacttcattctcgttatatccaatgccgtgggctcaattgggtaatttcccgtatgttttttcaatcagagtcctgcaaggggaataaaaggcgtctgccaggagacagccgccgcaatctgccgtcgctgaccgctgttccgcctgtttcaagggcttctgcggctgctggcaccgctgctgtgagcggttctccgcagactcacggcttctttgtgcgcgggagcagagcgcctccctgccggtcaagggcccgggagccgtgcccgcgacagacagctgctcccggcctcagcctctccggctcgttttcaaaaaattcatgaaccgttcacgaggcaaacatagatgaggccatccgggagtagtatacttccaaaagtatagacgagatcgtctgtaaaatcctcaggcagtagccgccgcgggttgcaaacctgacggcgtgtgtccggtcccataccggcgcggaattggtcggacgtcaaaatggcctgtccgtccggacgtttttccgctgcccgcccgggtgtctccctggttccgggttttggcagggccgggggttttggatcaggcagaaggaggatatgcagcatgacgcagaaagagcgccaggaacgcagcagaaaagagatttatcaggccgccctagaggagttcgggacctacggctacgacaaggtcaacatggagcggatctgtgggaaccacgggatctccaagggcatgatgtaccactactactccaataaggacgagttgtttttactgtgcgtcgaacgcactttccaggagctcagggcccatgtggaacgggatatggcccatctgtcaggggaggatacggcagccgcagtcaaagatttcttcatgatccgggagcgctttttccagcttcatccccagcaaaagctcgtttttgaaagcgccatgctccgtccgcccaaacatctggccgcgcaaattcaggccctgcgcgcaccgatgcggcgcttgaatcaggaatttatcgaggggctcatagacaaaatgccgctgcggccggatttgaagcctgaaatggtgacccgctatttggaaaccatcgagtctcttttccagaatatgattgtgagttatcagggcggacatcccgcgcaggatttccatgccatgctggaaaccgcaggcgaactgctgaatatggtcctatttgggattcttcgccacgcagatccggcatgatctccggttcggtggataacgtgatctttgccgcggcactcccctatctctttggaatgcggctgctgtacccgggcttcagcaaacttgtcagctcctttaatctgaagcggccggagggactaggccggggccggtgcaccgccttggttcttctattggcagcgggcggatttttcccggtctgcgcccctctccgggctgtccgcacctcagcatcctcagcgggagcctgctgatctttcaggatgcggcctcgatcctgtgcgcctgcttctccggccggttctggcggcaaaacagcaattgatgataccacaaggaggatttatatgctgaaattacttcgtaacctacggcggcaggagtgggccatggccgccgtgtgcgcagtgctcatcctggggcagattaatttcgatctggcgctgcccgactacatgagcagcctgaccgttctgattaaaacgccggggagcaccctgtcggacatcctgcataccggcctggaaatgctgggctgcaccctggccagcgcggtgctgtgcgtcatctgcggctatctgaccgccaaggtggctgccgggttcagcttttccatccgggaggcggtgtttcataagatcgcagacttcggccaacaggagatgatgaccttctccgtccccagcctcatcaaccgcaccaccaacgacatcacccaggtgcagatgctgacggccatgggcctgcagatcctaatcaagtcccccgtcatggcagtgtgggccatcatcaaaatcgtgggcaagagttggaccctctccgctatcaccgccggatttgtggccgccctgctggtgatgatggcggtcatcatcggcgtggtggtgccccggttccgccgggtgcaaaagctcaccgaccatatcaacctggtggcccgggagaacttgaacggtatcaatgttgtccacgcctacaacgctgaggactaccagaacgccaagttctggaagggcaacgaggaactgatgcgcacgcagttgttcaaccagcgggcctttgccttcctgatgcccggcgtcaccctggccatgaacgcattgtctctggtgatctactgggtgggtgcctccatcgtgaacgccgtccctgccgcggacaccgccgcacggctggccgccttcagcgacatcgtggtgttcggcacctacgccacctacgtcatcatgtccattatgatgatggtcatgattatcatgatgctcccggcggcccaggtgtccgcccagcggatcaatgaggtgttggagacccggaatagcctgactcagggcgcccgcatcgatgccctggaaaccggtactgtggagttccgggacgtctccttccactatccctcctcggacaagaatgtcctggagcacatcaccttccaggccaagcgggggagaccgtggcctttatcggcgccaccggcagcggcaagaccactctggtcagcctggccgcccggttctatgatgccacggagggcactgtgctggtggacggggtggacgttcgggactacaccttcgacgccctgtatgaccgcatcggctatgtaactcagaaggccatcctgttctccggagacgtccgcggcaacgtgctgttcggcgccagccggggcaaggattccgatgcggacgttcaaaaggctctggagctggcccaggccagcgagtttgtggacaggatgcccggaggcatccatgcccccatcgccgagggaggcaccaacgtatccggcggccagaagcagcggctctccatcgcacgggccctggcgaggcgcccggagatcctggtgttcgacgactccttctccgccctggactaccggacggataccaggctccgtgccggcctggaccgggagctgaaggataccactcgactgatcgtggctcaacggatcggcaccatccggaacgcggacaagatcatcgttctggacgaggggaggatggtggggatgggtacccacgaggaactgatgcaaacctgcccgatctaccaggagatcgcccggtcccagctctcccaggaagagctgggggcttaaggaggaaaccaagatgccaaagatgatgcagaacagaatgtgcgcgccgggaaagagcaggcgcggcatcggcggtgtgctcagagaactgttcacctattccaacaaattgaaagcgccctctgttgcggccttttgcttcgccgtggccggcgcagtgctgaccatcatcggccccagcctgctcagtcggatcacggacctcatctccgacgccctggacggggagatcgatctggccgccatcggccgcaccggcgtaatcctgctggtgatctacggcttcagtgccgtctttacctatgtggagcacttcatcatggctacggtcaccctggagctgtcccgggatatgcggcaggacctgtcccgaaaaatcaaccgggtgcccatgagctacttcagcaaggtgtcttatggtgacatcctcagccgcatcaccaacgacgtaagtactctgcagcaggccctggccaacagcctgccctccatgatcagcgcagtggcccaattcctcggctgtctggtgatgatgtttggcactgagtggcgtatggcgctggcagccattgccgtcacggcactgggcttcctcatcatggctgcggtgatgctccggtcccagaagtacttcaccgcccggcaggagaacctgagcaccctgaacggctatattgaggagatgtactccggccacgacgtggtgcgcctctcccgggccaacgagcaggtaaaagagaccttcggcgggatgaatgccgttctgtacgacgcagagtggcgcagccagttcctctccggcatcatgcagcccctgatgactatcatcggcaacctgggctatgtggcggtctgcgtcctgggttccgccctggccatgagcggagagatctccttcggcgtcattgttgcgttcatcctctatgtgcggctgttcacctctcccctgagcaccctggcccagggcatgacccagatgcagacggcggcagccgccggcgaccacgtcttcgactttctccacgagaaagagctgcccgatgagaccggcaagcgccgcgaactctctcctgtgcagggcgaagtcgaatttgaacacgtccgattcagctatccgaatcatccggataagatcatcatcaaggacttctctgcccatattcagccggggcagaaggtggctattgtgggtcccaccggagcgggcaagaccacgatggtcaatctgctgatgcgcttctttgagatcaacagcggaaacatcaaaatcgacggcgtgcccacctctgaaatgacccgggagggcgtccacgacctgttcagcatggtactccaggacacctggctgtttgaggggactgtccgggaaaatctggtctacaacaagaccggggtcacggaccagcagctggaggaggcctgccgggcctgcggcatctatcacttcatcgaaaccctgccccacggctttgataccgtgctggatgacagcattgccatttcctccgggcagaagcagctgctcaccatcgcccgggccatgattcagggcaatcccatgctgattctggacgaggccacctcctcggtggatacccgcacagagctcatcacccagcaggccatggaccggctgacggagcaccgcaccagctttgtcatcgcccaccggctgtccaccatcaaaaacgccgacctgattctggtgctgaaggacggcgatatcatcgagcaaggcacgcacaaggaactcctggccaaaggcggcttctacgctgacctgtacaacagccagtttgaaaaggcctcgtgatcccaggaagaggggggcggctgcgatttggacagtatggaaaatcagactccgccgtgctgaagcgaaaagaacagctcccgcttttcaagccattcctttgaaaagcgggagctgtttccctttccggagagcctggtttgctttggaggcagggctccttccacccgggcccccaatgatcggcattgcagcaggagcccccgtccatccctcccaggatttgtcaaatccgttccagcttcgcccggaaggatatctttcggggcgtctccatctcatcgaactgtaccacatgagcacccttgtccatgtccacatccagcaccgtaccggagccgaacagaatatgcttcacccgctgccccacggagaatgccatgttcccgtcggtctccggcagataggtctggctgtggccgatatagtcccgggccgcccggatcaagccctcctccggcggccgggtgaaggccaggagattgcggtcgatgtccagaagaaagcgggagggataccggggggtgccgtcgaagttccgtccgtctgcctcggagatgtacagtcccttctccgcccgtgtcagcgccacaaacgccagccgccgctcctcctccatggcctgctgcgtccgcaccttccgggaggggaagatcccctcattcatgccgcagaggaacacatagggaaattccaggcccttggcggcgtgaacggtcatcagcctcaccttgtctccctgctccgccgtgtcggcattggtgaacagagccacatgggccagatagtgctccagggtgacctcctccccgcaggtggtctcgtactcatataccgactgcttcagctccgccagattgtccagccgttcctggctgccctcggtgcggagcatcttctcgtagccgctctcattgaggagggccgaaagcacctcggacaccggtctcccccatatccggcggcaaaggactctatcaggccgacaaaccttccggcgcctgttcctttgaaaagtgggtcctccagattgtcctgcagcgcctgatacagggagcggccctgcctctctgcgtactcctgcaaaaatgccatccgccgcttcccaagattccgcttggggacgttgacgatccgccggaaggaaaggtcgtccttgtaggcaatcatccgcaagtacgagagggcgtccttgatttccatacggtcaaagaactggacgccgctgtaaatcgtataggggatcttctctcccagcaggacttcctccaccgcccgggtcacatagtgggcccggtagagcaccgtcatgtcccggtatggcgtgcccgcctcgtgaagctccttcatctcccccgctatccattcggcctccgcctcctgggtctgcgcgaagtggcagatgaccggactgccggagggcagcgtgggctgcaattcctttttgatacgagtccggttcttgtcgatcagggaattcgcggcagagagaatctccggcgcagagcggtagttctccatcattagaatcgtttttgtccccggaaacttcttgtcaaagtccagcaggtacttcacgtcggcgccccgccaggtgtagatggtctggtccgggtctcccacgatgaagaggttcttgtggtaaccacacagaacctccatcagctcgtactgaagctggtcgatatcctggaactcgtcgatcatgatgtactccagccgctgctgccacttgagccgaatgtcaggatgctgctggaaaatatacagggagaacttgatcaggtcgttataatccagtccgaaacacttcttctcctgatacagatagccgtagaaaatgatgtctgccggggtgtccgcctggtcatacttctccttcagcgtgtccagaggcatggcgatcatatccagatagtagtccggacgcttgaacagcttctgcatctcgaccatgtcccgggctgcggagaaggtcatatcccgcagcgtcaatccccgctcctcgtagatgatttggagcatagcgtcgatgtccgcgttgtccagcaccagaaagcttttgggatactggacggcgtagctgtcctcctggagcacggagacgcagaaaccgtggaaggtgttgatatagcccgtgtcattgtcgccggtgaggatgtggatgcgctggcgcatctcatttgcggatttgttggtgaaggtgacgcagaggatatttcccggcaggatgcccagctcgttcaccagaaaggcaaaacgatgggagagcgcccttgtcttgccggagccggctccggcaatgacacggacaaatccttcggtttcggtcacagcctggcgctgggcagcgttgaggccggagagcaaatcggtcatcgtggcgtcctccctgtcgaacatctgtttcttccattatatcagaacccgcagatgttctcaacctcttctgaaaaatccatcagatctcctatggctgaggattggcatacgaagaacagggaagaaggatgcagacattcaaattaaccgcaggtatagggaatccttgtgccgcaaatcacacttatttcaggccaagttcacaaatcatatcttctgccttagaaaattcttttttggaccatatttcagtggcataacaggaatttgacctctatcatttcaatgttttgtactttgccggtagcataggtgcttaatacaagaaagtatgaaccccttgcaatgcaaggggttcatacttaaaataaccctgcctgacccaaaataacgccaagcattcgcccaaatcaggcagggtcattcattttggcgcagcgggagggattcgaaccctcgtgcgattgctcgcaaactgatttcgaaggataaacagaatcccataccgccacatcgagccgttctaggtcaattaaaatgtgttgttttgctcaaaagtcgcacctttttctctgatgcagaggaatattcatgtagcatcaaaacgagtgagggcaccatttgggcaccataagcatcaaccaaaaatcagccgttctagttgttgatatacttgggtatccggtgttattaatggtgtaattgtgtcacgaataattgcttcaccattatttccacacgctgtaagtccaagcaactttttgatgttggttactatatcgttgctagcagatttaatatcatccgtggcatttcctcgactaatgctagcatttatcgcctgttgctttattgtaagggcactattttccaactctgctttcccaactgtagcgcaccattttttgattatttcatcgtccagtaaataggattcaaggtgacgcctatccagcaccttaattcccttttcagaaagttcttctacttcattttcacttcgatcatctcgatcaataattcgaatgacattggtgttcgggacaatagcttgtgttagcccaattacctttagtttgtcttcctcgatgtcgttgcagcctcctaatgagtagaacacagtgctcgggtgagttgtgctgaaaatatttgcatagcactttgcatcaaagtctttccgtttcctgcccctagtagtcccttcgcagaacactactgtttccggggcaagtaaggtagagtaattttctaaagtcaaagatagaattctattccacaaattatgtgaaacgggagaaggcataatctgaactacatcatcaaaatcaaatccatcaaaatttaagaatgcaacacttcccggacattcggcttcaagttctttggctttatttagcataccaagtgaatgcgtagcaatccataactgaccatttgctccgatcagagtgtaaagttcacctaagagtttttcctgtaatgctgtatgcatatgggcctctggctcgtcgatacagaaaatggtgtctggatagtatttttgcttaatgaccaagtctaatatcaaatcaaacgccgctttttctcctccagagagatttttataggagtaatttttggaaacccctttgtcaaaaaggaagtcgccattttctgtgggatttcccacaccagaaagagttaagtcaccaaaaaggcgagttagagattctcgaatttttccgattaattcatcacgtagtgtggctaccgatttctcgttgtatgatgtatcatatacacattcaagcgtcttagaaatcaaacgatggtagtttttcgcaacctcctgatcgttctctatcatcatgtttttatttgcaattgctgtaggcgcttccaccgccgatatacctttgatagctagagaagggtcattccgatacgcggttcgaaaatagaaaatcgaatggtttttattggtatcctcaccatcataatcataaaatgataaatcaactaatttgtttgaattttcataaccatcttgccctactggagttttattgcagtagctttggtctgtggggaggccggtatatcctttccacaattgccaaaccttaaatgcatcaaaaacggaactcttaccacatccattcggtccaacaagtacaaccaatcgagcacttgagggaatagctgttatagtcaaatctgtgaaacgtttaaactttttcagatgaatttctttgagtttcatataaggatgccaacctttctacaggttttttcaaattatagcatattcttaaagaaacagcaaggaacgtgtcaccggacacgttcctcttttactttgattctggcgctttccaatatgtattccttgatagccagctttggaatacgccatacacggccattccgaaaccccttgagcttaccgctgtttaggagatcgtacatagcattgtagcccattctcagggcttcacaggcttcttctactgtcagaatatcaggatattcctctaacattcattccacctcctgcaccgaaagatgggcttcacagcggggacaagcgctcaaatcaagcgagcaggagtcacataaacaagtaggagccttgggcggcgacttgtggcgcttggggttcagcgtcctttggtagagatccattttctcaatttgctgcatgactgccggctctgatctgccaacagcaaaggcgatttcagaaatgccgtagccttcttcaaacatcatttttacagttcgcttttcatcgtcccgccaaaactcaccttcgtgatcgaagcgaatcgtgccgttacggtggcggcgaatcatttcacgttcaatttcaggactcatcatggtttttctctcctttttcagattgatttaccatgatgttcctttattacgcacaaaaatctcaaaaaatctgtggagcgaaagataaggacatttattgtccatgccgtgtgctattctctaatcagtctgatccgttgcgcaaccatcggcttattctcctgcctatgttgtcaacaggtccggttaggcggcggatgttcgtgattgtggcacgactccgccgctgtttttccttaatacactgaaaggaacagcctatgaatatattattatccctcaagaaattctcccacattggctattacatacatgaagcccgaacaaaagccaaagaaaggaaaaagcaccatcgagatcgcctgaacctgtcgaatgaccaaatcaagtatttggataaggtcgttattccggaagggtgctcctaccaagttaatgaccacactttttccagcatagacaaggctttagcttattgcaagcggctgtccattgaacgatgcaaaaagatatggggagccggaattcccatcagtattaccaacccgaatgcacccaagatatttgattgcgcctgtttgcctgctggactgcttgtaaaggactccaaggactttctatgtcggtatgctcctgtccgtatcatcataattgctgtagatctgagcgaggtttacacggaatattttgatttgtatgaaagcgatattttctccaatgaacacctctatgactacggacttctttacggcaattatcctgtctatcaggaaaccgagctttgcctaagcaaatttagcgagcagtacaccaagcagatcaacacgccttttgtcccagaacccgcctttggtgatccgtccaaagaatataccgggctgatggatgttcatatggcctacgattgctattccgtggaagtgctctctgacggcactgtctatgacgatgggaactacgcatttcctttggggccattccagtatctacatttgtgaatatcggcagcgctggcgtgtattgcaagtgctggaatcttttttgggggtgctcccgctcctttgaggtcaatggcaaggaacattctcttttccgctctgcgctgttggcctgtaagcagtccgaattacctgttggaaaagagttctataccatcatcatgcaccagaaagaagcagacggcatcataccagcagattcactcccggtttccctgcgggacagctattcagttatgactccccacgcaaaaaagagggtgtttcatatttcgccccaatttgacgagatatattgggaaacatttgaactggcagattcgagcggaaatatccgcaacttttgctatgaccactggcttttagatcataactgtgaatggaacgtcggagatatctgtaagactacctattggggaaaatcccggtggggcaatccttgtatggatagaggtatcaaaattacatatctcccagatgctaaaaccccatactatggtagaggtgatttggaactttattgcaagatttctgtagggagcaacagtctaaacatccctctttccacactcattaagccatcttccacagaatgaaatagcaagtgagagtgacgagactttttgtgttctcgtcactctcacttgtttgattattctttgctcacttgttttttgtgtttaatggcacgtttagaatatttttcgactttggctgcttttgcgacaaagaagaatatagactcgccgaacaaaaataactgccaaaaagatactgcacctggaacgacgaatatacccaaaagtgtaatagccaaataaactattgctcttacaggtttattgagataaaaccattgtgcgcctacaagtcccagaaaaagggttagcagtccggccaccgccttgctctttggagccattgttttactctgagtttttttgatagcggaatttgacggagtttttttgtttgcagtattaccaacaaaagaggcgtttgttttagattgttgttcagcttccttggactgaactggttccgccttggcttcttccgctacattagtggtttgcgttttttcgcctgctttgggacatggggaaacatctgaaatttctaatggctttttatccattccaacagcagactgggcctcaattgaggctgggcctactgttcctatagacgtcgaagactttttttcatcagatgtttcttcagcctcggattgaaccttcatttgaatattttccgcagtagccttttcggcagccgttgccaatggaccagctacagtttttgcgttctcagataatccgtatgcaaaagcaatggttgaaaagtaatgtgacatactggggttctgtggaatatttagtgctttgctcccttctctatagtaattacctaatttgagcgccgcaaagggctccaatttttcggcggccatctttatcatttcgataccctgttcggagtcgttaattgcacacatccatctaccaatatctccaatcgctaaaatattaccggcatcggcaaatattttggcttcacggaagtatttactcttatcttctttgtgtcctacggattgccatctccaaggggtataatctaaaactgtgtgcataagaaaggcaactaagtattccgcaaatttattgccactgtttgcacgctgtatcaatgaagtcatcttttcacgaacggcatactgttctccacaagctggattagatagcttatagtagtagagttttaaggtaatcatggcctccaaatcatcacattcagccatatcccacagcagattttcctttcctgcgattatcatctcggcaagttctttctgctttcccttgatctgcttttccagtgcttgtgccttgctcgttctttcagcttctttttctatctctattgctttcttttccaaagctttgacataggtggctacattcaagtacggattatcccttgcgagcgtttcataactttctatctttttccggatttcctcaactgttttctctggttcggtctttattgagtcaacaatctttttgtctgcgctcagaagggataatttataatttctctcgttaccaaagaacttggccgcagaatgaatatccgatttcctcccggtaaaaagattatagaggtgaacgtaaagaatggtggaatatggcgcctgttgtatgcaatcgcataagatatctatagctttttcaacattttcagcggatgcctgtgatgcaattcttgcaatatagtttttagcccttgcatttgcggcagcttcatcgaaatcatattcatcaatgagatcattttcaatcagcagtttttctacacaataaaacacttttgtgctgaaatcgtaaacggtatcaaagaggcacgttgccactcttggatcaatagcaagctcctgtttcataccacttatctttgctttgtcgcttgctttcgtaagggtatccccgataccatgaaatgcccctgcaccaatgttgaatgctcctgcaacaattgcacctttgaccgctccggtgacaccaaacccgccaccttcccaatgacctctgcttgctttttttatatctctatagtctcccaaattttctgcatagcgctgaatttccccagcttttgcatatatgtatcccagagactctttgatgttgccactctggaccaccatgtttgccaacatggtgtcatcaatgtcatcaatgccgtattccataagaacgtcaacaccgaaacgaacggcagaggtgaccttttgaacaacctcggggatttcttcatcgaaaaggcccacaaatgtgtgctttcggctcttgtaaaacttgatatattcctcttcaagactttcggccttttcaaaaaaacgctttctcagtgtattgtactccaaaaaacgaggagaaaagaaaagttctcgaccaagtaattcaaactttacatctggttctactatatattctttggctttatcggcagtttcgtcagaatatcgtgttatatctgcgccacaataagggcaaagattgaagtcatcgtttaactcttttccgcaattatagcaaaacataatgcgatcccctttgcaagtttcttgtcagataagtatagcgtaatatcgtcataaattcaatgatttatgacgatatttgtaatctaacgattttgcgatgtgcagggtacaataataaaaacccctcgtgagggaggatgtgcctcgtgcttaaatttgatgtaacaaagcgaataaaggatctgtgcaatgcgtattcttggacgtattatcgattggccaaagaaagcgatattacctactccaccttgagcgctatgttgaacaaagggactattccgtctattcctactctcgaaaagatatgtaaaggctttaatatttctctatcgcaattttttgccgaggacgaatcagtagccctaatgacttttccgcaaaaagagtatttggcccggtgggagactttaacacaggaaaaccgaatgtgcgtagacaaatttattgattttttaaaagcaaagcagagcgaaacggatagatgaataattgaatgatatattatctccatgtataaagcccgaggcgaaacagcctcgggcaaattttgtttatggaggtaattgactatgaaaaccaaggaagtatgttcccattgtgggcatgaatttccccgaacagagctgacggagttcgatggcgagttcctttgtcccgcctgtctcgaaacggagacttcggtgtgcgaagactgcggaaggcgcatttggaacgacaacaatgagggcagcggcgatttgatcctctgcggcagctgttatgaaagaaactatgttcactgctcccgctgcggccgtctgcttcacgaaaacaacgctttctatttcggggacgatgatgagccgtactgtgagtcctgccatgatatgctggacagtcggatcatccacgagtacagctaccgccctgcacccaacttctacggcaatggcccccgctttttcggcgtggagcttgagatcgacgagggcggcgagtatgagtccaaagctaagaaactgttgaacgtagccaaccgggatactgagaatatctatatcaagcatgatggcagtctggatgaagggcttgaactcgtgacccatcctatgtcgcttgaatatcagctgacaaagatgccctgggtagaggtcatggcggaggccgtgcgacagggctaccgctcccatcaggccaacacctgtggtctgcatgtccatgtgagccgggaggccttcggtgcatttgcggtggagcaggacagcgccattgcacgtgtgttgttctttgtggagcgtcactggaatgagcttctgaaattcagccgccgtactcagcgccagttggagcgctgggccgcccggtacggctacaaggatcatcccaccgaaatgatggagcatgtcaagaaaggccggtgtaaccgctatacctgcgtcaatctgaccaatgaggataccattgagttccggatcttccggggcactctgaaatacaatacgctgatcgccacgctgcagatggtcaaccgaatctgcgacgtggcgatttgtatgtccgatgatgaactcagagccatgtcgtggagtgagtttgtgtccggtgttactgagccggagctgatccagtatctcaaggaacgccgcctgtacctcaatgaacctgttgctgtgtctgaggaggtctgatatgtgctgcttattcggacttttagattacggccactctctgactgctgctcagaaaaaccacattctggcggtgctttctaccgtctgtgaggcccgtggcaccgatgccaccggaatcgcctataacaccgataacggattgcagatctataagcgtccacttcctgctcaccaccttcgattgcgtattccaaaggacaccaattatgtcatgggccacacaagaatgaccacgcaaggctgtgagaaacacaaccacaataatcatccgttcagtggccgtgcaggtggggttcctttcgctctggcccacaacggcattctccacaatgaccatgaacttcggaggcagaggaaacttccttccacaaaaatcgaaaccgacagctatgtagctgtccagctgatcgagcgatccggagaactgtcctttgcaagcctgaaacagatggccgaagccgtggaaggaacctttacattcacggtaacggacaatacggacaacctgtatatcgtgaagggaaacaatcccctctgcctgtaccactggcccaagttagggctgtacctctacgcatccaccgaggacatcctgaaacgggccttacagggcatccggctcaagctgggtaaaccgcaggaggtcaatatcgactccggggagatcgtccgtattgaccgctttggccgtattacccggagcattttcgatacctcccatcttttccgcagccgcagttactttggctggccctaccgcttttccctctgggacaacgataccgcttatgacagctatgtgtccgaactgaaatcggtagccagagccttcggatatgctcccgacgatattgatgatctgctgaacgatgggtttaccccggaagaaatcgaagaatgcttttacacgatggaggtatgacatgaaaattctcatggtcgaacccggcaaggcaccgaaggaaaagaacatctccggcactctggattccatgcaggaagctgttggtgggacgattcaggccatctatccctttgacgaacctgtggctctgatttgcaacgatgatggcaaactgatgaatctgcccatgtgccgctctattcacgaaataggggatatcatcttcggcagcttctttgtctgcgccgccccacccgggcatcggaatttcacatctctatccaaggagcagatcgagcgatacaaggagcggttccgcttcccggaaacttttctgcgtatcggcggcgatgccatctttgtgctgagaaatttgtgattgttcgttaaattgtagaaatacgactaccaaaatccagtgttttcaaggctttcagcggattggccttaaaagttcgtatttcccaggacgataattcgtatttcagactggattggaggtgcaaaatgaacaagcgaaccgtggctctgaccacggagcaatacaaggaaatcatctcaaccatgaagcagggcttcaccggatgccgtccgaacccacgggcggcaacggcactcatgctggaagcaaacttgggtttgcgcatctcggacattgttcagcttcgcctgtgcgatattgtcaaggacggcaaccgctatcgtcttgccatcatagagcagaaaaccggaaaggcccgtgtgtttaccgttcctctggcgctgtatcagtttatccgatgctactgtctggataatggcattgggagcaatgatctcatattcccggtcacggaacggtcggtacagaagcatctgaaaaccgtctgcgactatttgggtttctccggtatcagcacacatagcttccgaaagtattacgcaacggagatttacaaaaacagcaactacaatattgcgttggtccagcagctcctgcagcacagcagcgctgccgtgacacagcgctacatcggcatccagcagaaggagttggaggatgccattgaaagccatttgaaattagacgtttgaaaggaggaacccgcagtgatttggttcttggttggatttgttatcaccatgatcgctttctgcttcaccgaagtctgcaccgcaaaatgattcccgctatcatcatggatgccataactctgttcctgaaaggtgccagtgccgctattgcagtgtatgtgtccatgctcaagaaacgggacaaatgatttgaggggttagggcgctggccctaaccccttttctatatgtcaacttttggtttgggggaggggaatggggcctcaacgccctgcgggcggctcggccttcccctcccccaagcctctttcccttctggcccaaacaatacctgctcaccaaactttactgtgtcaatgtgcttgtgtcagaactactctaaattttacgggtcaaaaagcataattacggcggattcacagtcgatgattcaagctgcttttgacactgacacatcggcacaataatttatcaatcctgttccgtatgcgtgaaagcaaggtctgacaacgattgtaactttgtagccctgttattttgtacaaacgaactgctttcgtcaataaacccaccatctcttaaaaatcgcaacacaaaaagcttttcctctggtgtacctcttgtaatcgcaaggaaacatttcaacaaatcaaggtctttgtacccaagtttctcgagcgtaaagattgtttcaagtatatgatatggatccttttctgttattctttcgcatctgttgctcttgatatcggtacggcgctcctttgcgaaggcttcatccccaatcttttgaaaaagtctttgtatcaaaggaatgccaaataatgcatttttaatcacttcatgccgcttgtctttggcatcacagattcgtaagaaaacctgcatcaactcacgatcctctttggaagccaatacaccatctttataaagggccattaccgcttcatccgcataaatcagcgctggcggtcttggtgtgctattagcgcaactgagtgcaaacattataggctctgtaattgtcggcaaaaacttttctactggaaactcccccgtatagtccaatgggttatctgttttcccaacaaggtacagcggagatacatcatagattaaagcaaacagcttaagatatgttctgtcaatagatgcccttggcctgagggcattctcataaccaacaattgaaacatgggacaagttaagtagatttcctacagatgtttcagtcaatccaattctttcccgacattcacgcaattttgttgcataatacgagactgttttggggtcaatcagctccgcgtccttgagtttgctgatagctatctcggtttgcgttacatgagcaggaaattgggtctcaatttttccacaggtcttgagtacttcttttttcttgcgaggcatggtttctctcctttgtaactttctcttgttgaaaaaaggttgtttatgttgcgaattctcgactttcagttttcgtggcaggatgaaatagtcaaatgacaccaaaatcagcaaaggagagtttgccatggaaaagaaacattccaacccgtaccttgagcacattggttcacagcaaaaactattcgaacccatgatacctacacgaccaattagggacgtaaataaccactcaaaagttatttacatagacgaaaccagagaacgcatccccgatccgccgaatccgagaaatctgttaatccctatggactttcatgaaccggatgcaatcgatatgagcaacaaagagatcctcaagatgaagggccttgtttcggaaccggcgatgtacagaaatacttccatacccacgtcaacacctgtgtaccgtcagatacaagttccttcaaaggatgagcagcccacagtgcaggaattgcttccgaaagtcaaagtatcaaaagctaccgacgctgagagcgctccctctacctcagaagacaaaatgtcaccgtatgatactgcgcagtatttacttacacgcttccacatgaagtcaataagtaatgtactgcacatatttgatggtcagtgttaccggccatatccaacagatacagcgttacgctttattgttgataagtgtcgctcacaagccaaggccgccggtacccccagttttcctaaatcggtatatgattgtcttcgcaacgaacctcgcattgaatgcaaagtgggagaaaacagtactgaacgctatcgctttgtaacttttgagaatggaaccctcgaccttaaaacaggccagctacatccccattcaccccaatattttacaacatactgccttaaatgtcagtataacccgagcttcgctaatctgtctacgccctattttgataccttcctccatcagatgagtggtggtgataggttgttagaggccagggtgttggaattcattggctactgtcttgttccggatcttgatgggcgagtaattttcttgcttcaaggttactctggcgcaggcaaatctttaatttcgaattttctccgcagtctttatcccgacgaagtcgtttcatcgttgaatgtccatgaacttggtgacaagttcgctgtgtccgagttgagtcgcaaggtcatatgtttgtcgcctgaccttcccgccggagtgctcgatgataagtcagtcagtgctctgaaaaaactcagtggccacgacaaagtatcctccgatgtaaaattccaatctcgggtggaatttgagtgcgaggcaacatttgttttagcaacaaatcacatgttatgcaccaaaaggagagatgaggcattgattgaccgtatcgttgtaattccctttgccttccccgtggcaaaggaggcccgcatgccgtcgttaatcgataacctaaaggaggaaacggatcgtatagctaatcgggcactacaggcatatttttgtctccgcagtaagcattacatcttttctggcaactacgagatcaatgcggttactgaggcaacatcaatcagtagcgacctcgaatcatgtatggcagcatttgtacaagactggattattcccgatcccaatggaggtgtccataattgcgaagcctgcgaacttttttgcagcatttataatcttagtataaacgataacgctttttcccggttatttactcggtttgtttctcaaaaacatcctattgaacatggtcgggtgagattgcccggtggtggaaatcccaaaaattacataaaaggaatacgacttaaggatggagggcaagtgaaatgagaatttatgcggttttcggagataatgctgttatgattgagtattcctatgagcacgcaaggtattgcctgcacaagtacttccgtggtgcacattacaccaaagcattcggcagcattgccgaggcaacagccgaagcaaccgaccatctgtgggaaattgccccgctgaaccgggctataccggagttcctcaaacccgggaagatttactttgccaataagcttcccctgaatacccaaggagaatagccatggccaagaaaatgaaatctgacccgcctgaactgctcccgatgctgatgccggccagtatgatggcaaaggtttccgggatcggcgaggcaactctgcgaaccttgatggcacagggggaaatcgaatacctgcagatcggcaaccaccgcttactcagcgtcaatgccatctgggcctattacgaaacccataagacaccttctaagcctgctattaaggcgaggtttgacgctatccagaaaatgaatgcggagagcgcataatcaaatctgtcccggaaggcacacgccttccgggactctgatccaactataaggaggcaaaaatggctattacagaaagaaccgttcaaaataagcgtaacagtgtcggggaattaaccgggaaacccggtatagtttacgacgtgaacatcaagcacaaagtcaacggacagcagaaaacacattccaagaaaggttttgccacaaaaaaagaggccttgcagtacgaagcagccatgaaaaacaagctttcaaatccgtcctatgttgcacctacagctgcccaacggaaaatgactgtggaggaatatttggaggaatgggtcgagcggcacggaaatgctaatctccgtcccagtacaaaggccagctacaggtctcatatccgtaatcacgtgattccgtatatcggaagcgttccgcttgggcaggtaactcctgccatgctggatgatatgttccggcagttgtacgagaaaggtctctcccatagctcagtgaaatatgcccatcgcgttgtaggggttgctttcgaacacgcacggaagtaccattacatcgaaaacaaccctgcaagggacgttatcactaagttcggcaagcagggcaagactcctgacccttatacgaccgagcaaatgagcacactatttgccaatgtggctggttccaagtgggaactgatcgtggttctcggaggcctttatgggcttcggttgtctgaaattcttggtcttcgatggagaaatattgatcttgaatccaagacgtttgctgtggttgagcagctgccgttcggaataccggcgggaacagtgaccattgatgaaatggctcctgtaaaatccagtgatcgtgtcctgccgatcacagaccttactctgccatactttcagcgccagctggcattacaggccgaacagagaactttgctgaccggagcgggacaagcctgctatgacaatgatttggttatcgccaagcccaacggggcaccggagcgccgggagcgggtatcctcgaattttggtcagcttctgaggcacactgggatgcctcatatgcgttttcatgacttgagacattcggcagcaaccaacatgcatcagcttacaggcgatttttataccgtaggtatgatcctggggcacagcttgaagggcatcggtatccagctcggaatctccaataaccttgagtctgtcaccgctcagtatgtagatgtgcgtctggatcggaaacaggtggtgcttgatacataccatagagctgtgttgagtggcaccaatgtttaaataataaggccagcgttgaatttcagcgctggccttattctcaacgtatatcttttagtaacactcttatctaactatcggaataaacttccctagatattcgcgcaaagcatcatcgcaaacatatacataggttcctaatattccgcgagtcagcagaactgcgtaagtgttgagaatatagttttttaattcatcatctgctacagaccgtttcactttattgtcaaaaaagtgttttcgattaactctaacttctctgctttcagtatcataatacaaatccgggccaataactaccgcagcatagttcagatcaagcccaggcaatgaatatatgctgcccatctcctgctttgcgttcgggtttctaagccatccgccagtctggcgattccaccatacatcaactccatcgatagatatgtccggtctatcaggagagtctttcgcaatccacttccaagcataccctccacacaatctacacaagccaacagacttttctttcatatcaagagtctcaatcatatcgctaaaggagcaaaaaatcttgaattcatagtttttgaaatttaaagcggagagctgtttttgattcaatacggcatgaatatagggaacgtagtcgtttccggcgcgaatacgcatctgatcctgtagttctaccggacggataccacaatgtgaaatatcaaggcgttgatgaaaaacatcgtaaggaatatcagaaggacacgcaatttgctttctatcgtagagcaacacaagacaatcggagtttttcacaagccagtctaattcgtcatgcgtatcatccaaccccagcctagtgttgccgcttcggaaattagtaatatacatacccagatttttgtttcttcgtaatctgtgcgcctcgtcacaaatgataatgtcataatgcttttttgtaacatcaattgggctaataatctctttatcatagcccccaggcagacgcttaaatgcagatcttagttcacttcgtgtggcagaattggaaaataccaaaccgacttgctttccgttgaaatcagggttcgtcttaaggtgatagaacaaagaggatgcaatgaccgtctttccggttcctgcatcaccttccagaagtatgggcctagccttttttgcctttcgttgttttgtgatgcgctggtatgtatggcatttacaatatttgtcaaggtggcaatctgtttatctgtaaggctcgtttgaggagaatacttaaactccgttttattcaggatggcttgaaactctttgtgctttaccaatccacgctctaccagctgtggccatagcctgtcaaagcccagttcaaactcgttttttcgccgataaaatgtgcgttcaccctcactgcgattgatgacatgaaatctgcgatcaatacgcattaatttaatcaaaagtttttcaaaatgctttgccggagtttcttcaatgtcctcgcctgttattacgtggattctcttaaaatgaaaacggtaacaccaatcatccttacgatgatgctccttgcttcgttcaataatatcatttgtctcaccgacatacgcatctctgccattctctaagatatacacatagtgaaaatcatgagggaatgtccatttgccgtagtcaggggaggcatagtcatatgtcgtaatttcaaaactaactgttgtaaccatttccatcacctttgcatttaatcaggctacattgattatacaaataaaatcatacaaacacaaccgaaaatccctgttatcatatcgtcttatacgtttccgtatgatgcgtggtaaccctcaaaagctatatgagttctgcatatgatattctgaagttttatacgtttctaccgcccctctgggcaccatttgggctccacagcattcattttcgccgaatggtattcagtgcttgggcaccacaaacagggcaccatgggcaccattttggtttttgccgcaatcgaaacttaatatcaagcaaagagaaaacccttggaaactcagcatttccaagggtttttggcggaggcggtgggattcgaacccacggacgggattaaccgtcaaacgatttcgaggggaataatgcataaaatatttgctcatatttgtgcataacgttttattttgccatggaaagtagctatataaaagaaaaattccatttttcttcacactggtgaatttctgacttcatatcatcacagatcggcaaaagcaccatttcggcaccacgctaagcaatcatcctccctggggtaacgtcagagacatcgcggcttaagccgcgtcaaatgaaggccgtgcaaccccctggccggacgggggttgtaggccttcatttgacgccttcccgacagggcgccgaaggccaaaattttgacgatgtgggagcggaggtcgtagacttgtcttaaacctctatactttctatcaagtcagagctgtaagtcccttttctttcaggaacgcatcggaactattgatagccaaatcaatgtcgacctggttaattcgattgacctcggtagtggagccactggagagaacgagctggactttgcacatctggaagaggagagctaccagttggacagtgttctctgtcataagcttctccgaatcggtaaattcgttccagtcagtttttccggtaagaatcaccaagttgcccagttgggcgagatgtcgcatatacacattgttagtagcagacagagctttttcgaaccgttcttctgtcatgtgcaaagattcaagataggcacagattcggtcaatttctgtcttggcttttttcatctgttccatagcctcgtccgctttggctgagagcttgtttccggtaaagttgaagataatgccgcctaccaggagacccatgcccagagtggtggcaccaagaatggtggttccaagagctataccgccgccaccggcagccagtgcaccaccacccagggcagccagcgtggcgttagtggcagctgcaccactaagcgaggcgatggcagtgcctgtggaggcagtacccaaagccataacggcagcagtagtagcaccagcagcagcaaacccaccggcagttcccaaagctgctccactcagccctcccagtagaacaccagcaccgaccgacacctttttcagatcctctggactgtatgttggaatcgtgacgtcaccgtgcttgaaagcgcggaactccggcttattctggatgcgctcaaaaatgtctgagaacttctgaaaactctgcagaatctccagctccagctttcccagacgatccatggcagcagtgcaacgttcattccttatctcaaaccgcctgacattggctgtatgtgcctcttgagtttgcttcatggtgtcattggcttttttcattttaactccaccatgaattgcactcccaacaccagctgctccggcaactgctgctgcagctcctaaaattaaaggtaatggcatcgtaaattcctcctatttttctaaattctttagtctttggcaggcctcgcggttcaggcgataatatgtatcgataggcatcacttccttgaagaatttctggtagctctcgtctactctgcacagcaatggacgtttctcataaatgctgcacagatttccagacagatatttgcaggtgccatcgccccgatccagctctgcatacagcttagatatatccaggtgccgacagcaggctccacaacgatcacactcaaacatagcgattgctcattcgtaaatcagatgccggctcttatccctcataaaagtgtcaaaatcaccttcccagggaatcgaaatgccaagctccaccatgttctttttcaaaaagaaattgaggctcttttcatcttcgatgcagtcaatataactttcaagcggttggtattgggcggtttctttttggaatgcagccaaatcaattcttttgagttgctccatatatgtttgcagtgatgcggtaattttcttataggcatccaactgcttttgcagaggtgcttgaataccagccctgaggcaaatttcctttagcaccagcaccgtgaaacgtccccatgcgatgatgttcatacgagtaaaaaacattagccaatttccaccagaacggaccaatgcgtctgccccatccatcaaacataatgtaccatgtccgaaaaggagcattatgcgcaagtcggtatgtgactgggtggggatgcactcctttaatggcttcttgaaatagaatcgctgctttatcatccagataaaacggaccaatagctcacaaagtagtacaggaagcgacatggctatgccaaaccgggcgtcgtacccctcttgaaaggctcgaacagccaatgtggccaaatcttgtttatcctgtccaatgttgaactttccgaagttgcaaaattggaagagttcaaaaaatggaatcgccacacctgatcctcttccaatgttaccgcgactaccagaacttcccgcaacatcggacatgatgtgtccaaaccaatttacaatgccgcagaaaactttagagacaaggttattgccttgcaattcaaaggattctgttttgatagtaaccagttttcccccgctcacaaacgaagatgtagatgtaaattgatttaagactgagaaaaacaatccgatgatatcgggcgaatgtgacagagatttgatgtggtggtttttggtactcatattgaatgcaccgcccacatccgctgaatatctctggtcgtagttgactttatattgtctttccagataaccaattgcactagcaacgttgccttcttttccaggtcgtggagaccatccacttttttctgcaaatttttttacagcttcatctacttgcgcatccgtccattttccaatgacgctttggctcggtgcacctactagaaaaatatcaactaaaccagagactgccccacaggccactgcaattaaatagtcggatgaatcgcaggcgtgtttctgtagcagttcaccatcttttttttcaattaaatcctccattattgcatcccctttccttgctcattcgttttttgtgggcagtctttccaaattacacggtccccctggcttcttagccacatttcaatgcccttgccaaagacctccgcgcggatctcataacatccgtcgtgctcactgagtatctccgccgtggagagccggtccagtaccgcctccacggatggccctttatagataaaacgcaccgtttccagtttcccgccgtacatgaactggacccgcttccggaactccccctcagagaaacggcggctgtatggcacctggaagtgctcgtccagcacctggagcttctcgatcctgtccacccggtagatcgtggggaagggatcatcggcattctcaaagtgctctgcccggtcgatgccctcaataaaagcggtcagatagaaatagaactccgaaaacagcaggcccacaggctggagccgtcggctcttccgctctccctgctgggtgcgatagactgcctcgaccacggaatggctccaaatcgcctgtcccagtgtccaaagctggttcgagagccgtttcccatgatatggctccacatagtagaaccgctcgttcgccaggatctggcccaggagcttccggctctgcggggaggcacaccggctcaggagcttatccagaatcggctccatctcatccttcggcatggagcggctgtccagcaggattttgcacaccgccagcagctccccgcaggagagaaagctcccggcggcggaggtcagctcataccgctgctccttcgccttgtataggatctcctgcggcggctcctgactggcaaaaaaattacgcaggcagtcgatgtccctctggatgctgcgctcgttgacaccaaagcgagcagcggcttcttttttctgcaatccctctccgtggaccagcatttcatagagatacagcaggcggctgttcttgtctgtctccacgccaccacctcctgtctctatcatagcagcggacatagacactttttgtccatgtaaaaaattgcgctgaaagttcaacgtcattataccctaaaagttatatccattcaaccccacaagttcatttatagataaaactctccgggttaaactgatgaaaaacggaggggcgctatggactgggtatcaatcggcgggagaattcgcaggcagcgggaatttctgggctacacacgggagcagttcgcggagctgctggacgtgacgccgaaattctgctcggatattgagctgggtgtcaaggggatgtccgtccagaccctgtgccggatctctgaggtcctgcgcctgtccacggatttcatcctttttggcagggagaacaccgagagttccagccccatcacgcagctgctccgtagctgttcctcctctgagcaggcctatgcggaacagcttctgaaaacctttatcatggcaatgaatgcaaaaaaagaatcgctttgacaagcgattctttttttgcgtccactcccgatggggaatggattagatctcaccgctgtaaaacaggtcttccagctcttcagcggtgaagccttgggcggccagcaggtcaatatcctccggagaatacccaaaggccagcgccacggttttcagttcatccaaatgggtcgtgtctttttccgcatgggggaaactgcggcagtatggatcgttcatcaggaaccgggggtatctgaaccggaacagcttgctgtcatcaaaggtctcccggtcgagccgcccagtctggttaatccgcagaatctctccgcactggacaggaaccttccggctctttccaagcggtacttgaagcttccggagcgcctgacgaaggatttcttccgttgaggcatagagatagagaccgcagtccgggaagaaatacaggcagaaggggttgtctcccttgacgatgtagaaacttccgtcatctcccagcaccgtgatcgtgaaggagccttccagcagctccgccatataccggaggctgtcaaagttcagaatgcccttctgcacaatcagctggacggcgatgtagctgtccgtctcaatcctggttctggaaagatgcaggctcttccgcaggctgatgtcattgtctaaaacgccattgtgggccagggcaaaggtcccagtctgcatgatcccccggaacgggtggttgttatagttctttctggcactgccctgggtcatcatgcgggtgtggcccatggcgaagcgggagttgtcgcggacgtagaagttcagcttgtggccgggaatgggcttcttatagatatggagattcctgccggagtcataggccacaccggtggcgtccgttcccctggcctcactggcagatgccagcgcatggagcatcttggatttttccttcccggtaaagcgcagctccgtgtcgatcaatccaaacagacagcacattgtcacacctccacttccgccatgaccggctcgttgacatacagacgccgctctttcagataccgcaccagctccggagcctgacagccggagacaaaggaagtccaggacagggctttcagctcgtcgtcagacagatagatcgccacgtcacagatccggtcaacgagctgcaacgtggcgatcagggtattgtatttgagtgttccccggaacatccggaattcgatggtgtcccggttggtgaggtttacgcaggtatagcgcccgccgtgataccccttcttggcgtgatccaggatctccatgggctgctccttatagccgtaacgggatgcccactgatccagctggtgctgggtgcggcggctgaatttcagcagctcttcccagtgcttctcgaaaaagtagaggacacgggcaatggcggtgtcctgttgttcctcagtctctccaaaagccagacgactcacatggacatggaggccacaggtcccggcctgatggctggtgtagcccagatccacagctcctttgcagatttgctcccagggtatctgctggagctggtagctcagggacatggggtgcgtgacgatctcaaatccctcttccagggagccatcatgcttgcagtagatccgttcctcttcttcgttggcgatccgcaggagttttttggcgttggagccgtactccccggctccatcgatttctagctccacgccaaagaacctggggccgtctccatagaaaatcggctccggtttgtagcagtagtcctgaatggcccggtcgccggcggtccgggtatagcaggcatggcagagcggttcttcctcgtccgggtcatcccggtcatagtaggcttcgtcgttgtgaagcagctccccgcagcggacgcagttggtgtaatagcggtcatagcaacgctcgcagagcggcgtgtcactgttcccggcattatcgtcggtccagatccgttctccacagacatgacaggtcacggtctcctctgcaaaacagcgggggcaaaggaattgcccgtcgaactcttcccgctgggagataaggtattcacgtccgcagatcgcgcagacataggtttcctctttcatcactcattcctccttcatcacttggtcgatgatcgtacataagatagcagcggcggcagccaggatgatccccaggacatttttcctggaatcagttttcaccccagggtgcagaccttgcggagcagctggtctaccagctccaccagaatagcgcggatcacggaaagcagtgtgttcagcatggttttcctcctttttcctttcaaaatgaaaaagcggcggcgattgctgaatgccaaaggcattcagcaatcgccgccgctctataagaatgatatttctttgaaagggacaggaaaagcaaacaaggcgctatctgggaaacagggggataatcaaccggaatggaggaatttgaaatggatcatagcgaatacagagaagctctggacgcctataagcaggaacgtctcccggtggtgctgaccgccgccgaggccatggatcttctcggtgtggggaaaaacaccatgtaccggctcttaaagtcgggggagctgccggcagttcggattgggcactcttggcgtttgactttggaagcagtcgaatattttctctgcaaccgtagctaaatatttaaatgcccctcataacgcaagaaaatatcagatagaatctcggagtccgaatatgttccgctttccgccaaatagtgactgtataggtgttgattattgtaatacagatataaaatatagctgtcagagaagcttattttatccaaaagagaattacaaacaggatctgtattacctgctaagtatttgtaaatcacaacacaccatgtttcaaagactaaatcccgtatgtggcgatcctctaaatttggaaaagatgaaggctgaaataccgcaggacgcaccatttcactatttttagggggttccacttccttgatttcggtaaagaaatccttaaagccaaatattcggctcaatgatttaagggattcgataataaaattatattgcgaaagaggaactccgcattcttcattgataaaggcgttctcgacagaggtactccctctcagaataaaaaaatttttactaaaattgcatatataagcagtcaagaggaagggcaaaagactacaaacagccgattcttccaaattgagcatttgatgaacatacctgaattttcgttctaatggtatgcttccaagaacactcggacaagtagggggtgtaggctccatgccctttttgatttcgttttttaattttttaaaaaggcactcgcattttgtgcgatttcttatcagcaaatattctttgacatcttcaaaagagtcttccaaatcttcaagataccaccatgggtctaatggctgaagcttcttcgctcctggtcgccgggtccgcagcttaaacagcttattgaaatgcgcatcgatatcttgaaagtgatgttcaaattcacgctctatagtttcccagaaggtttgtgtattcttacaaggcatcaataactcattatctgctggacattcactattgctttcttcgcggatgttttgtgctggaatattccgtgactgatatccgtgtatcatatactccacgacggagcctaaggcatgttcttctcgttccaaaagagatgctataatctcccaatttttcatagaactcttccttttttagcattgcttaatttaattcaggcgactaattcgtagaaaaagcgggccgtaaaacaggaaaaatatggtgaatatccctaaatccagatcagaatacagagggggcacagcaaaattgagccccctctgtattctgatttgtcctctgaaaaccaaaataagccgcatgaaaaaaaagaagcgttcgcggcaattgccgagtttgtatatgatagctctcgagccggctactacacactatctggaggagtcaagatgagtacgaaatttctgttccctgattgggagaacgaggatgacgattcgcaggatctctgtggacgtatgcgcgagatggcggaggaagccgcccgacgggagcgccaggggcttccggagaaaaaggagcctgaaccgccggctcccacagccaaaagccctcggaagcgggcgaatttcttctccgatctggtggagcagatcgcaaaagccaaaattctcctgtttaccgaggacggggagccgttcgcctatgacgaagagctgggctgctaccagcccattccccaactgacggcatggcttgcaaacttcttcccggaaatcacgacccggagtcttttggcgaacgatctccgcgaaattgcccagcgcctgacttggcgggaagacctccggtgctgccgcgatgagttcaaccggagtaaagaactggtgaatctggaaaatggggttttcaatctggaatctggcgagctgctggagcacgatccccggttccactttacttaccaggttaaggccagttacctggaagatcctgagcaaatcaaatgtcccgttctcgaagatttctgccgttcttctctcgatggagaccctaaaaagcggcagctgcttctggagatgatcggctacatttgctccgacctgaccgttgggaagtgtgctttcttcctacagggacaaccaaattccggaaaaagtgtcatcgccgagttcatcagtcggttatttgatccatcgctcgtgtccaatgtaccgcttcatcagctaggagaacggttttcccgagcagaattggcgggcaagaaagtcaatatcgccggcgagattgctgggagagccttacgggacatctccattttcaagtctgtcaccggcggcgaccgtatcacgggcgagttcaaagggaaagacctcttctatttcatcccacggtgcaagctgctgtttgcaggcaacacgctaccgcggacgaccgaggcggataccaccgccgcctttgcaaaccggctcgtggtcctactcttcaatcagagcatcccgccggagaaacaggataagagcctgctggataggctttgcaaagaggcggactccatcgtgacccttgcgcttcatgccttgcaggacctcatggaacggaattttgtgtttgctctaccggaggattctaaggcatttctggaatcgtttgtcaatcgatcaaacgtcctgtccggctttataaaggaacgctgtatcctctccccggaggctcgcgtattcaatacggacctctttgcggcattcgtggattattgcgcacagaatgggctggaggcactctcactcagccagttccatgaccttttgtctggaattccaggcgtctacgccaagcgcatccgtatcggaaaagagaaccggcaaggacatgtgggaatctctctaaagaaaagcgaatcccatggaactttggaacaacagcctcgaacgcctgcgtggctaaggggagaaagttccacggaaggtggaccacatatcatttcaaagagggaggaagacgatgcccagcaagaaaaagcgtgaagatctcccgctcttcttatccccggatcaggcagcaaaaatcagcggcctcggcgtcaaccgcatccgccagctgatggaggatgggcagttggagtatctgccagtcggcaaccggcggctgacaaccgtccaggctctgctggactattacaagcgggccaaagtaccggctgcggcctgaaaggatgcgttaccctgattttaccatctggccctaggcgcgtcaagagtaggtgggcggtggtttgcttggagagcaaaccaccgcccacctctaaaaggaggaataatgtatggctgttacagaacgaaccgtgagaaataagcgcaacagcgcgggagaactcactggaaaggccggcactgtgtacgatgtgaatgtcaagtacaagtccggcggaaagagcaagacctattcccgcaagggcttcctgacaaagaaggacgccttacagcatgaagcggagatgaaagcgaagctgacaaacccggcatacacgccgccctctgctgttcagcgaaaaatgactgtgcaggagtacatgacggagtggatcgaccggcatggctctgcaaatctccgccccagcaccgaggccagctatcggagtcacatgaagaaccacatcttcccctatatcggagatgtatttctgaaccagctctccccggccatgctggacgatatgtaccggcagcttgctgaaaagggcctctctcagtcctcggtcaaatacgcacaccggatcatgggcgtctcactggaacatgcccgccggtatcactacattagcagcaatccggccagggatattttgacgaagttcggaaagcagagcaagacgccagatccttacacggtagaccagatgcggcagctgctggctgttgtcatggggacggagtgggagctgatcgtagtgctgggaggattgtatgggcttcgcctcagcgagatcatcggactgcggtggaggaacgtggatctggctgaaaatacctttggcgttgtggagcagctcccattcaacacgcctgcgaacaccacagtgatctctgagatggctcccgtgaaatccagtgagcggacgcttcccattacaccgctcgtcagaccatactttgagcggcatctggaactccagaaggaacagaagcgttttgcaaagcagtcagggaatctgtactttgacaacgaccttgtattcgcaaagcctaacggctctcccaagcggcgggagcggatctccgcgaattttggacagttgctgcgtcacgcagagatgccccatatccgctttcacgatctgcggcacacagcagcaaccaatatgcaccagctgaccggagacttctatacggttggacagatcctggggcacagcctgaaggggatcggcattcagctccagctctccaacaacctggaagccgtcacggcgcagtatgtagatgtgagaatggagaggaagctatatgtcctaaacatctaccatgaagcggtcctgggttccagtgagaaaacatgaagcgcggaggtgcgcgcgatgctcatgcatcgcgcgcacctccgcgcttgccgcagcaccgcagtgctgcgaatctctttttgtgacctctcgaactgtggaaatctcacgtattttgatattgctttttataggtcgcttttgaggtgacgggcaccatttgagcaccacagcaaggaaatcccgaatatctcattcactggccgggcaccacaaacctcggcaccatgggcaccattttgctgctgacgatgggaattgagaaatcttcgggaaaaatagaagtccttgaagcattgtgcttcaaggacttcctggcggagtgggtgggattcgaacccacgtgcccttgcggacaacttgatttcgagtcaagctcgttgcgaccacttcgataccactccgtgtagaaatatgcagtttttatgaatggatcacatgatttcgagtcagccccgttatgaccacttcgataccgctgcatatctagttgtgagaacgcaaatcaggataactgtgagcattttgttagcgtttttccgaagcgccgctcacacccgcgcccggaagcccttgggagacatagccttttggctgttagcacgtcccgccgacgtagcgatttcaagtcaagctcgttgtgaccacttcgatgccactctgtacagttccgtcctgcgagacgggaagcggttttattatggcatattttcgggaaagtttcaaggaaaaccttttaacttttcgttcgtttctcttcgccccgcttttaaccaccgggcggaactctggacgtgctgcccggatagaatgggcctgagacatttgacaggagggatcgccttgcgtccaacagtgtttctctggggcctgccgggccagtacatcaattacgagcgtgcgctggagatagcaggtggacggcccctggcctctccggatctgcgggatgcggtgcggtgtgccgccctgttgttgcccggcggcggcgatatggagccccggcgctacggccaggcaaacaccgccagccgggggctggagccagagcgggacgcgggagagctgttcctgctggagcagttcattatggagaaaaagcctgttctgggaatttgccggggactgcaggtgctgaacgtgtttttcggaggcacactgatccaggacctgcccggccacagccaggcggcgggtcgggaccggctccaccgggtacggacagccccctctcccctgcaggaccttttcggagagaccttggtggtgaacagcgcccatcatcaggcggcagaccggctggggcagggactgcgggcggtccaatgggccatagacggcacggtggaggcggtcatccaccagtccctgccggtgtggggtgtccagtggcacccggagcggctggccggccccttatccctgtccggagccgcagatggagggtgccttttcaccgcctggctggcgctggctggtggcacaggacaatcttagaaaaaaattgcgggtttccgcttgacagatgggcttgtccatggtaatatatctaagctgacgatttccacggagggcagacgcaggtgtagcacaatggtcagggcaccagccttccaagctggggatgcgagttcgattctcgtcacctgctccaatcaaattcgcgccagtagctcagctggatagagcaactgccttctaagcagtaggccaggggttcgagtcccttctggcgtaccaactccttccggggcggtcggtcagcacgcatcctgtttaggatctcgatatgtggtgggtgtagctcagttggttagagcaccggattgtggttccgggtgtcgtgggttcgagtcccatctcccaccccacaaaagaggggatcggggtcaccccggtcccctgttttcctttccattggggcgtcgccaagtggtaaggcaagggactttgactccctcatccgctggttcgagtccagccgtcccagccaagactttccagcccgcccgcattggacggccgaaatagaataccatgtgatccgttagctcagcaggcagagcaactgccttttaagcagtgggtccggggttcgaatccccgacgggtcaccaaaaagaaagacacgactttcgtcgtgtctttctttttgggtttcgcaggccattggcccgcgaaacccttcggcgattcaaatgctcggcggaaatgaattctgcctccgccaaggttccgcctgcggcaaaacgcttgtactgcgcaaacgcaccgtcctgctgtgcggagctccaatgtccgcatctcttctgtcaacacaagctgtaaaaacctcctgaagggctaatgcttcaggaggtttttacagccggaaaataccagggattgttcgtaacgggttaccagcaagggatatatcaaatttcgcttcgattgccctgtaagatttggagtcgctgtgaagtctccgccagcaatttcaatgccgatgcttccagcaccgcctgactggccgcctgcatgatcgggcagatctgtccccccaagaactctctgttggcttcgcacggaagcgattcattcgcccgtgccggggcagccgctgtggtgctccgcccgctcccgtcccaggctgcttacagggtcatctcctctcccggctgaaggactttggcggcaaatcccgcctctttgcaggcggcggcgaatgcctccggatcctgggtgatggcctggaaggtgttgtagtgcatggggaccgtcagtcggggccggatcagcttcactgcccggagggcatccgccgggcccatggtgtagaaatctccgatgggcagcagcgccacgtcgatgtcctcgtctgccagcagggtcatatcggtcatcagggccgtgtctccggcgtgatagatcttcctgccccccatctcaaaaaggaagccgcaggcaggacagcccgccgcaccgccgccgtggagggcctggaaaaacttggcgcagccaaaggacaggcggaccgtgccgcccagatttccggcgacgcatgccacccccgcagggacaaacaccgcatccgccagatccgctgtgcagcagaccggcgcaccggtacgtctggcgatggcggctgcatcccctacgtggtccccatggccgtgggtgacaaaaatcacgtccgggtccaccttctctgcccattcaggacggccagccccggtgaggaaggggtccgtcaggactttgtggacgccgtcatccagcagaaagcaggcatggcccagaaattgcagcttcatatatgcagcactcctttttccaagatgggacggacagctgtcagagcctccgtcggtcggttctcttgatgggatgatatcatatccggtgggcaaagtaaattccagcctccacgaaaaaagcggcgccgggctttttcgggcccgacgccgtccgcatattccatctttcttacagccgggccaggatggcatcgcccatggcagcgcagcccaccttctcacatccgggccgccagatgtcggcggtgcggatgccgtcgttcagcacttgattcaccgcagcttcgatgcagtctgcctccgccgccatatcgaagctgtaccgcagcatcatggccgcggacaggatgcaggcgatggggttgatgatatcctgtccggcgatgtccggggcagagccgtggatgggctcgtacagcccccgggtgccgtcccccaggctggaggagggcaccatgccgatgctgccggtgatctcgctggcctcgtcggacaggatgtcgccgaacatgttctccgtgacaatcacgtcgaactgggcgggatccttgcagatctgcatggcgcagttgtccacgaacatctcccggtattccacgtccgggtactccgccgccaggcggtgcatcacctcccgccacaggcggctggtgtccagcacattggccttgtccacgcaggtgagctttttctggcgcttgcgggcggtctcaaagccgatgcggccgatccgctcgatctcgtgctcggaatagggcatggtgtccacggcaaccttctcgccgttttcctcgtaggtcctgtgctccccgaagtagacgccgccgatcagctcgcgcaccacaataaagtcaatgcctttttccacgatggcgggcttcaggggcgaggcgtccgccaactggggccagattttggcagggcggttgttggagtaaagccccatgccggcccggagccgcaggaggcccttttccgcccgcttgtcaccgggcaggccctcccacttggggccgccgatggcccccagcagcacgctgtcgctttgcaggcacttgtccagttccgactggggcaggggatccccgtaggcgtcgatggcctcgccgcccatcaggacttttgtataagtaaaggtgtggccgaatttctcagccaccgcgtccagcacccgcagggcctgggtgacgatctccgggctggcgcagtcgccgtagatcaccgcgatattcttctccatactgccgcctccttaccgcgcctggatgctggccatcaggccgccggagcgaatgatcttctggatgaagggcgggaagggctccgcctggaaggtctcgcctgtggtctcgtcggtgatgacgccggtgtcaaagttcacagacaccgtgtctccctcccggatggcagtgctggctgacgggcactccaggatgggcagaccgatgttgatggcattgcggtagaaaatccgggcaaagctggcggcgatgacgcaggcgatgccggcggtcttgatggccaggggcgcgtgctcccggctggagccgcagccgaagttctcgccccccaccatgatgtcgcccgcctgcacccgggtgatgaaggtcttgtcaatgtcctccatgcagtggtccgccagctcccgggcattctgggtgttcaggtagcgggcggggatgatgacgtcggtgtcgatgttgtcaccgtatttgaatacagaacctcttgcttccatggtgttcaaacctccctgggatcggtgatgtggcccgtcagggcgctggccgccgccgtggcggggctggccagataaatctcgctgttcacgtggcccatgcggcccacaaagttgcggttggtggtggagacgcaccgctccccttccgccagaatgcccatgtagccgccgagacacggcccgcaggtgggggtggagacaatgcacccggcgtcgacaaaggcggtggtgtagccccgctcgatgcaggtcctgtacacctccatggtggcgggaatgatgatgccccggacgccgtcggcgatgtggcggcccttcaaaatgttgtaagcggcctccatgtcctcgatccggccgttggtgcaggagccgatgaccacctgatcgattttgatgtccccgccctcggcggccgggtgggtgttctccggcaggtggggccagctgacggtgggcaccagggtgtccaggtcaatggtgatggtccgctcgtactctgcgtccggatctgcctcgtatttcttccattcccgccggctgcggcccttcaggtacgcctcgcaggtctcgtccaccgggaagatgccgttcttggcaccggcctcgatagccatgttgcagatgcacagccggtcctccatagtcaggctctgcacgccggggccgatgaactccaggctcttgtagagggcgccggagacgccgatgagtccgatcaggtgcaagatcacgtccttgccggacacaggccgccgcagactgccggtcagctccacgcggatggcggcgggcaccttgaaccacgccttgccggtggccatgccggcggccatatccgtggagcccacgccggtggagaaggcccccaccgcgccgtaggtgcaggtgtggctgtcggcgccgatgatgcagtctccggcggtgacgatgccctgctccggcaggagggcgtgctccacgcccatcttgcccacgtcgaagaagttgacgatgccgtgtctgcaggcgaactcccggcactgcttggactgctgggcgctcttgatgtccttgttggggacgaagtgatccagaacgatgttcacccgggtcttgtcgaaaacatcgcaaaagcccgccttttcaaactcgttgatggccaccggagtggtgatgtcgttgcccaggacaatatcaaggttcgcctcgatcagctgtcccgccttgacgtgctcctggccgcagtgggcagccaggattttctgtgtcatagtcattcccatgggtattgtgcctccgttctctgtgatgaagtccaggggtctcccccgctgtttaccggttattgatggcactgaccagcgcccggacgcctgccacgatgatgtccgtgtgggtgccgcagccccaggtctctctgccatctggccacttcagccctacgtagctgcaggcccggctgtcggtgtcagggtccagtgcgtgctcgctgtaatggatcaatgtgaagtccatgcccgctgcctgctcgatggcattggccaccgcgtccaggcggccgtttccggcggcgccgcactggatcatccggctgccgcggcgcagagtcaggttggcggagatggacccgtcctggttctgtgtgtagtgggcggcagtgacattcagcggggccgcgttgttgacgtagttgtcctcaaacacctccagcacctcctggacggagagttcccggtggtcgtggtcgctgacctccttgacccggtagcccagctgctcccgcatgtggggcggcgggttatagccgtagttctgctgcagcaggaagccgatgccgcccttgccgctctggctgttgatgcggatgacgtccgcgtcgtaggtgcggctgatgtcgtgggggtcgatgggatataggggcagtcccaccggtgctggtggtgctccttccggtaggtcatgcccttggcgatggcgtcctggtggctgccggagaaggcggcgaacaccaggctgccggcgtaggggctgcgctcatagacgtgcatccgtgtcacccgctcgtatacctcgcagatagcgggcatatcggagaagtccagcttcgggtccactccgtggctgtacatgttcatggccagggtgatggcgtccacgttgcccgtgcgctccccgttgccgaagaggcagcactccacccgctgggcaccggccagtaccgccagctccgcgtccgccacgccgcagccccggtcgttgtggggatgggtggagagaaccacggcatcccggtacttcagatgcttggagcaccattcgatctggttggcgtagatgtggggcatgctcatctccaccgtcaccggcaggttgataatcatgggacggtccggcgtgggctgcatcacgtccagcactgcgttgcagacttccacggcgtactccggctctgtgccggtgaagctctccgggctgtactcaaagaggaaattgccctcgtactcccggctcaattccttgatgagcttggcaccgtccacggcgatttgcttgatctcctccctggacttgtggaacacctcccgccgctgggcctcgctggtggagttgtagaagtggatgatggcccggggggcgcccttcaccgcctcaaaggtccggcggatgatgtggtcccggcactgggtcagcacctggatcgtcacgtcctgggggatgcggtcctcgtcgatcagcttgcggaggaactcatactccgtctccgacgccgccgggaagcccacctcgatctccttgaagccgatcttcagcagcatctcgtagaactccagcttctcctccaggctcataggcaccaccagactctggttgccgtcccgcaggtccacgctgcaccaggcgggggcagtctcgatatggtccttctgcatccactcgtacacgtgccccggctccaccggcgggggatagtagccaatctgatatttcgtcgcgtccatcatgtcaaagtcctccttccaaggtcttgtctttggaaggaggacaacaaaaaatcccatctctccaaagaccatcagtctttgagagacgggagcaaaaaatgctgtacccgcggtaccactctcattgccgggagacccggccactctgtacgatcggctcctcctgaggggggcgaatcgcgtctgcatgataacggacagcggccgtccgcacctaaaggcgacgcctctcagcgcggctgctcaagggccagtgacgcggtcccctccgtaccgccttgcaccgaccggcggctctctgaaacggggcgtgggatcgccttttccccttcatcgcattttggaagatgggaagagtataacagctccgccgaaggacgtcaagtgaggaaatctgtcctcacagcggatttggtacggtttgacagacatctcttggcaaagcgcgccgtctcttgtgaaaaccgcaagaaaaaatcaggacggctgccgccgtcctgaagcggcggcctccctccggaagaccccgctacggaagcggaccactccccaggagccgggagggcgggccggttgtatcgtgcatcccgaaaaatgcccagcacctcacagcgccgcacctgtccgccagatctgcgtctccgtggccactatgggtacccggcggtcatggaggcccactggtacgcggggctgcagcaggcggtcggggcataccagaatggcgggcccctgatagtactccaggtagcggtcgtaatacccgccgccgggggagcaggtcacgccaaggtacgagaggcgcagatgcgcacccgggtggagggcgtcaggtcaactatgcggacctgcagaccgggcggggtcctatcacgatggagccccagttccccgtgatcccggggctggacatcgtggaaatcgcggaggctgtcggaaactgcgctaccgtgctatataatgaggacaactatgccaagctgcccgaggaccttcagacggttctgcgggagtgcatggaccagatccgggaaaagaacaacgagatcacgcgtgatgaggatgcctattatatcgagaagatgaaagccgaagttcccgggctaaccgtgacggaatccgattatgggtctttgctgctgtgggccgtgcggtccatgaggagctggtcgccagcgtctctgatgaagcgctctgcgatgcaatccaagccctggcctgagcaaggaaggttccctccctgcaagggtctcgtttgggagacaaatgggacccttgcagaaaacacaggggcgcccactgaggtaaaacttataaaaaagtatatgcgccattttccttggccattgtgcacgctcctctccgccggtcttatgagagatatcatacagccgggagggaaatgcgacaatgccccgccgggccgggcgattttcagcttgtctctttgccggttgtgcggtaaactggacgtatcgcggcgccggacggggtgcagccgtggataccggagcgcgccggggcgcctccggcatctgcatccggtggaagcgcccgcatctgcatgaaacgagaggaagcagacatggactatctggacttggaagcccccggcctgacggcggggaatgtggaaaaaatcgccgcgctgtttcccgccgccgtcacggagacgcgaggcgcggacgggaaggtgaaaaaggccgtcaacttcgaggtcctcaagcagctgctggcccccgacgtggcggagggggaggatcgctacgaattcacctgggtcggcaaacgggccgccatggccgaggccgcccgccccacctccagaaccctccgccccgtgaaggcggacagccgggattgggacaccacccggaacctctacatcgagggagacaatctggaagtgctgaaaatcctccaggagagttatctgggcgcggtgaaggtgatctacctggacccgccctacaacaccggcagcgatttcatctatccggattcctttgtgatggaccgcggcgcatatcacggtgccagcggataccgggacgcggaggggaagatcaactttcagcggaaaaacacgttttcggacggcaggtatcactccgactggtgctccatgctcttttccagactgctgctggcccgcagcctgctctccccggacggcgtcatcctgatctccatcgacgaccatgagtcagcgaacctgaagaagatctgcgacgaggtgttcggcgaaagcaactacctgaaccagttcgcgtgggtctccaatatcacgggccgccagatatccggcagaggcgcggccaaaacctgggagtccgtcctggcctacgccagggacatcgacgcgtgcggcagcctgtccattgacatccgcttcgccagggagaagatgcccgatgcgtacaagggctttcgcagggacgttcggacggaccggctgggcccctttgcggtcggcgatcccctctacaatcataatcgcaagttcaacgaagagacccggccgaacctcgtgttctccatcttctatcagccccagacccaggagatctccacaggcgccatcggggagaggcggcccgggtgggtcgagctgccgccccatgcaaatggggatggcgtgcacaagtaccatgcctggcggtggtcccggcagaagattgcggacgagccatataatctgatcgtgctccccacagcgtccggtaggtatgagatccacaccaagatcagggacttcggcaggacgctgctcaaggacgtcattcccgacatccccaacggagacgcggagctgcggaagctgttcggcggccggaaattgtttgactacccaaagtccgtggacctgttgaggaccctgatcggctctgttccggggaaggatttcgtatgcctggacctcttctccggctccgccaccaccgcccacgcggtgatgcgcctcaacacggaggacggtggccaccgcagcttcattatggtgcagctgcccgagccctgcggtgagaagagcgaggccgcccaggcgggcttccagaccatctgtgagatcggcaaagcccgcatccgccgtgccggggatcagatccggaccgaattccccggtgcctgtccggacatcggcttccgggtcttccgggtggacgagggctgccggaaggaggtcctctatcccccggaggagatatcccagccgctgatcgggcagacggtgtccaatatccgggaggaccgcaccgacctggatctgctctatgcctgcctgctggacctgggcctgggcatccacctgccccacaccagccgggtggtcggcggctgcaccgtccaccgggtggacggcggcgtcctggcggcctgtttcgacgctggcgttccggacacggtcatccgggacatagctgcttcccgcccccagtgggctgtcttccgggacagcgccttcgcctcggacgccgccaagatcaacgtgacggagatcttcaaaagcctgtcccccggcacccgcgtccaggtactctgagtgcagaccgtccgcctggttccattccgcagaaactttccccgtcttgcccggatgtgtccccagcgcaccggacataaggaggtgacctcatgaagctccaattcaagcaccagccctttcaggcggaggcggccgcagcggtctgcgatgtgttccgcggccagtcactgtgcgcccaggcacaccggcagggcctgggcgccgcggccgacaggccgctgtccctggcagggaccggcaccggcctgtgcaaccaacccctggctccggagctgaccgacgcccggatcctgaaaaatctgcacgcggtccagcggcgcgtcggattgcctctgtccaaggccctggccgggccggggatcaacctgtccgtggagatggagaccggcaccggcaagacctatacctatgtgaaaaccatctacgagctaaacgcccgctacggctggagccggttcatcatcgtggttccgtcggtggccgtccgggagggcgtctaccgttccctgcagacgacccaggagcacttcgccggggagtacggcaggcggctgcggtttttcatctacaactccgaccgcctcgcccaggtggaccgcttcgcctccgacagcgccattcaggtcatgattatcaacatgcaggcgttcaactcgggcaggaaccagcggatcatcgaccagcggccggacagcttccggggccgccgccccatcgacgtcatcgcggccacccggcctattctcatcattgacgagccccagagcgtggagggccgccagactcgggagagcctgcgcaagttcaacgccctgttcaccctgcgctactccgccacccaccgggaggcgtacaacatggtgtaccgtctggacgccctggacgcctataaccggcatctggtgaaacggatcgccgccctgggggtgaccttcacatcctcccccgccgctggcggctttgtctatctggagggcgtggacctgagccgggacagggcccccgccgcccggatcggttttgaggtcaaaggggcgtccggcattcggacggtggtgaaacagctgcgccggaaggcggatctgttcgcggcgtccaacggcctggccgaatacgccgaccgctatgtggtggcagagatcgacggtcgggacagctcggtgacctttctcaacggcctgaagctatatgccggtcagttcagcggcggcgaggagcggacagctctccagcgccgggtgcagattcgggagaccatccgcacccacctccgccgggaacgggagctgtattccaggggagtgaaagtgctgtccctcttcttcatcgacgaggtgtccaaataccgcctgtacgacggggacagcggcagcggccgcagcggcgagtacgccaaaatgtttgaggaggagtacgtcgccgtggcggaggcgttccggcgagagatcgacgacccggcgtaccgggcctatctggacggcatcgatgcccgcgagacccaccagggctacttctccgtagaccggcggaagggccgccaggcccgctttgtggagggaaagatcgaccgcaagagccgaacctccttcgacgcggacgcctatgacctgatcatgcgggacaaggagcggctgctcagcctggatgaacctgtgcggttcctcttctctcactccgccctccgggaggggtgggacaaccccaatgtgttccagatctgtatgctgaagccccagacggagtcggagatccgcagccgccaggagatcggccgcggtctgcgcctgtgtgtcaatcaggagggcgaacgcatggacgaaagcgtcctgggcggggcggtgcaggagctgaacaagctgacgctcatcaccgatatggagttcggcagattcgcggaggccctgcagcaggggctggcggcgtcccttgccggccgcccccggatggtggagccgggcctgtttgccggcaggctcctcactggcaccaccggggcacgggtccgggtgacgcgggagctggcagatgagatctgtgccgctctccggaaacagggctatgtgaaggaccgcgtcctcaccggcagcttctttgcggaccgggaccggggtgccgtccggctgggcggaagccttcaggacctcagcgccgccgtggcgcaagtcctctccggcgtctataccccccgggccatccccgcggagaacgcccacggcggcaacgtcaccgcccgggcggacccggagaagctgcagaccgaggcgttccgctccctttgggcgcgggtcggccccaagtccttctacaccgtctcctttgacacccgggagctgatcgggaacgtcatccaggctctggacgcgcatctacaggtgacccccgtctctgtccggacggtgtatggcgagcaggcgacgcagctgcagtcccgggaacagctgcttcagggccgggccttccgccgcagggaaagccgtgtgcaggccgccggtcccccggcgccgggcggtgtacggtatgacctagtgggcaggctggtggaggaaaccggcctgacccgtaccactgcggcagccattctccagggcatagcccctgagacatttgccatgttccgcctgaatccggaggatttcctcctccaggcctccaggctcatcaaccgggagaaggcggccgccgtcgtccggcacatcacataccaccggctggacgcgtcgtatgacgccgccctcttcaccaatgccgtccgccggggcaggctggggtgcaccgccgtgcccgccgcccattcgatctcagactatgtgatctgtgacaccgacagggaacgggcctttgccgaggcgctggaggccagcgaggcggtcagattatatgtccgacttcccaagtccttcttcattcccaccccggtggggcggtacacgcccgactgggccatcgccctccgggaccgcgcaggggatcccgtctatttcgtggcagagaccagcggcagggccccacagccccagggcgtggaggcggcgaaactccagtgcgcccgcgcacacttcgccgcggtcagcggcggagaggtgatgtgcggcgccgtccgtgacttggatgagctcctgcgcatcgtgggctgaagccccggggccgcacagtatgcacggcggcgtatggaaggccccccgctatggacagagaagcgcggcctgaaatcaagtgatttcaggccgcgccggcttgtgtgcagctgtgaggtctgcaagaattcgaatacactgccggttccccggctttcagcaagcgggccgccgcagcggcacgctccggaactccggcccggcggagtctgtttgagccgccgcatccccggtgcgccgccaaagccggcccccatctcagggcagaactgcctgtgccaggcggttgtcaatgccctgtcccctcccccgcccggggtgcgccgccccgcccccgcagacggcggaaccgccggtgagaagcagtcttcccgccgttctcacgccgtcccgtgggggatgatgaccttctccacccggatcttcccatcctccgcctccgccgtcatcatggtgatctcctgatggaaccgccgagggccgcaggagcccgggttgagccagaggacgccgcctttctcctcctgcacgtacttgtgggagtggccgaacaccaccgcgtccacaccggccaggtccgccgggacctcctttctgttgtggaccatgaaaaaggtcacgccgcccagggtaacggtgagatcgtgcgggatggcctccgcccagtccttgtcgttgttgccccggacgatgtacagcggcgcatactgccgcagctcatccacgatgctctgcctgttgatatctccgccatggaggatggcgtcggcggtctttagatgctccgtgacctccggccgcagcaggccgtgggtgtcggagagaatggcaagtttcataggtttcccctccccctcagatgataatgccctcgcagtggtcgatctcgtgctggataatctgggccgtccagccggtgaaggtcttgatccgctcctggaatttttcgttctgccagcggaccttgatggactcccaccgccgggctctgcgggtgccggagagggacaggcacccctcctccgcctcataggggccggcccttttcacgatctccggattgaacatgaccatatagccgccctggttgtcgaaggcgatgatgcgcttgttcacgccgatcatgttggccgccatacctacgcagccgtccctgtggacttccagtgtctccagcagatccgccgccaccggcaggtcctccggagaggcgggctcggccttttgggccagaaatgcctggtctttgcagatgtcccgaatcatgatgggtcctccttgtgtcgttgaatcgccgccgctatggtctccgccgcaatgcgggccccctgcccgctggggtggacgccatcggcggcgtagaggtcctgcgtgccgggcagctggtaaaaccgccgccccacgtcggcaagcagggcgcggttttcctccgccgccctgcggtacgccgcggacaggttccgggccatcccaccatagtcccatcccttggccgacagccgggccccacccttctgataggcccaggtggcatagagcaccgggatggccccgttctcccggatctgccggcagagccgctccacgctggcgaaaaagctcccgggagcggtgatggggccgtggctcatttcctgcagcaccacatagtcccactgctcctttgcaagcgccgcctgcgttcgggcgcccagccgggtgttcgggttcagatgctcggacagccgggccccgccccgggtatggcagaccacttccgccccggtcagttccgccagaatgtccggcatatcttgggcagaggtgaggctgttgcccagcatcagaatccgcatggtgctcctccttgtctcgtttccgtgcgcgtctgcgcgaaaggctcccgccgtcaatgctcggggcagcgctccataagccccctgccggatttgctgatatccccatatcccgccggagccgcagcggcccgctctgggcggcaccggttctcccattgatggttccctccagcaggcgcacggtgccggggaacgatgcgtttcatggggcgaaatcccggcggcaagggccctgtgcccctgctccgcgaagtggcacaccgtcataggccggggagacgttccaccgcccggcaagggtccggcagcacccggcgaaggtccgggaagcggcaatgagcatttggcccggcacccattcccccggggaccgggacggcaacgcgaacagagggatcttcccccgtgccagctccaggccggtcaggaatcgctccatccgctccgccgtggccttgggcctgcggccctgcaaaaggtcattggtgcccagcatcacgatcagcaggtcggtgtccgccggaatgtcaggtgccgcgtcggggagctcccggccgttggcgccccagttgcccaacacccatccggtttcggccgccaggatgtccacccatcagctgcccggggcacagcgcccgcccagccgggaccggggatcgtagccccaggtgctggaatcggcgaaacagatgaccttcctcacagctgtccctccaaggcacaagccccggacgtgccctcaccttccccgcatcccgtttaggccggtgcgtgcggtgctattctgcctgcggcatttgtgatttcatcacggtgcaattcatagatatgcggtatgatgaacccactcaatttagggaggcatgctatgaattccgtgaaaaagcggcgcagagccgtggtggacccgtcagcctgtgtggcctgcggctgctgtgtgaaggtctgtcccctgcaggccattgagatcgtgcggggcgttatggcccaggtccggcaggacaaatgcgtgggctgcggcaagtgcgccagggagtgtccggccagcgtcatcaaaatccgggaggtagaggcatgaagaagcactggtacgactatctgtggatcgcttcgctcctgtacctcctgctgggatttttcaacattctgtttgcctggctgggcctgctgtgcttcttcatccccctcatcatctccgtggtcagcgggaccaagagctactgcaaccgctactgcggccggggccagctgtttgggctgctgggcgggcgcttcgggctgtcccgcaggaaagacatccccaaatggatgaaaagcaaggcgttccgatacggatttctcgcctttttcttcgccatgttctttctgatgctgtggaacacctatttggtgttcgccggtgtgcgggatctggggcaggcggtcaccctgctgtggaccttcaagctgccctggaactgggcctaccacggcacccttttccatcccggcgtggcgcagttcgccttcggcttctacggcgtcatgctcacatccacagtcttggggctaatcaccatggtgctgttcaagccccgcagctggtgtgtctactgccccatgggcaccatgacacagctgatctgcaaagcaaggaacagccgcacatgaccgtgccgtatcacgcggctcaatcctgcaactgccgcagcctgtcctcatcaaggagccggaccatgccccgggagagccgcaccatgccctcgctctgaaaatagcgcagcatcctggtaatcacctcccggtgggtgcccaggtgattggcaatggcctcatgggtgatcttcagcacgctgctcccctcgatggaagcctcctccagcagaaaggccgccacccgcttgtccaggctcttccacatgacctgctccatcagccacatgacctcggagaaccggctggccatcagctcgttggtgtagttggccacaggcgccgacgtctccatgatgtcctggtagacctccgcgggaatgacccagaggtccgtgtccttctccgcctggatggtgacctcaaactggatggagcgcatgatgcaggacgcagagaacaggcacagatcccggtcgaacaggcggtaaatggtgatctcccgcccctcatcagagaggatataggcccggagctgccccgccttcaccaggaggagtccggtgcagtccatgtccccgttgtgcaggatcgtccccttcttcacggttcggaaattcagattgctgcggatccggtcctgctggtctgtttggagcttgttccagatgggaaaatagtcctgaaaggtcattccgtgtccctcctcatcgtgttctcagtatagttgacaggagctttgctgtcaaccggcccgcttttcggaaaatcccgtgttttgggtgatgtcgtcacagaaaaatcgcggactttcggttatactaggaccaaaccaaggaaaggagctgaccagcatggcggctatcaatctaaacaaggaacaattccagcagatggcagagggcggcaagcccatcctggtggatttctgggctccctggtgcggctactgccgccggatcgggcccgcgtatgagaagatcgcggacgaatacggcgaccgtctcaccgtggcgaaggtaaacatcgacgaggaggccgcgctggccgaggcggcgcagatcgaggtcattcctacgctggtcctgtatcgggacgggaaagccgtggattctatcgtcaaccccgggtccaaagcggccatcgaccagttcatccaggaggctatggcgaagtaaggaggcggaatccatgggcgaaactcgtgtctacgacatgatcgtggtgggcggcgggccgggcggctatacggcggcgctctatgcagccagggccgggctggatacactggtgctggagaaactctcggcaggcgggcagatggccctgacggaggagatcgacaactatcccggctatgaggacgggatcgacggcttcaccctggcggagaagatgcagcggcaggcagagcggttcggtgcgcagacagcgtacgcacaggtggagcgcatggaactgaccgctgcccccaaggcgctgaagaccagcgaggggaccttttatgccaggacggtaatccttgccaccggagccaatcccagggagctgggccttgcaggcgaggaggccctggtgggccggggtgtggcctactgtgccgcctgcgacgggatgcgctacaagggcaaaacggtcgccgtggtgggcggcgggaattccgccgccggcgacgccctgcttttgagccgtatcgccgaaagggtggtcctggtgcaccgcagggaccagctacgggccacgaagatctaccacgagccactgatacaggcagagaacgtggaattccgctggaacagcactgttacggagctgctgcacgaagagaagctgaccggcatccggctgcgggatgtgcagaccggggcggaatccgtccttccctgcgacgggctcttcatcagcgtcggcagaaagccggccacggagctggtgaaaggccagctggagctggatgccggcggctatgtgacggcggacgaaaccacaaggaccaatctccccggcgtctatgccgtgggcgatgtacggacgaagccgctgcgccaggtagtgacggccgtggccgatggggccatggcggtccacatggcggaagaatatctggcaggcggcgcctgatcgaagaaatgcggcagagaacggctgaagtcctcccgcatatatgcccatcccgttcaaaatgcaggcatccgggatgcaggcggcctgaaaagaacacagctgcccggagtatctgatggaacagattcctccgggcagtttttgtatccttgttttgcagagcggcaggccacggaaaaggaacctgtcatgcggcaaaccgcgcggtccggcggagccctttgggcaggatcctcagttctgttccagcagccgtctgacttctgaaatactgtccaccggccgggcacaggcgccgttccggcatagatagtaccggacgcctgtctccggaatcggataggcctccgtgaagggggcaagctcctccagcggctttgccgtctccggcgttttcaccagcaccgtcagttcgggcctggaggcctcccgcagaaaagccgccaactcctccggcatggtccgggccgcgcagaccagctccgccgagggccacagctcctccagaaacaccagcatggcaaaaccgtgtccggcgggataggtccgggtggccccagccagatagcccagctgcagatcggcggcggtccgccagcgggcctccccggtgaggcgggccaggcgggagagaaccagcgccgctgccgcattgcccgacggcatggccccgtcataggtctcctttgtccgggtgatgagctgttccccatccgccgcgtaggggtaaaacccgccgtttttcccgtcaaaaaactgctccagcagccgtgccgtcaggtccccggcctccgccagataggcggtccggaaggtcacgccgtagagttccagcaagccccaggcgcagaaggcgtaatcatccagctttccggggtgggccgcctgccccgcccgccatctggccagcagacgaccgttttcctctgtgaggctccgcttcaaaaatgccgcggctcccacggcggcgtcccgatagcggggctcatccagggccagtcccgcccgggccagggccgcaatcatcagtccattccatgcggcaagcaccttgtcgtccctgtggaggcaggtccgttccaagcggtaggcatacaccctctcccgcaggggcctgatgcgcaccggctcccgctggacctgttcccggccgattaggttgaggatatttttccccgcaaagttccccgtctcggtgacgccgtaccagccgcagaacgcctctgcgtcctccggtcccagcaggtctctcagctcgccttcggtgaatacatagtatttcccctcctcgccctcgctgtccgcgtcctgtccgcagtagaatccgccctgaaaatcacgcagctcccgcaggacgtaatccagcgtgcggcggacgatctccccatagagcgggcgccgggtctgctgataggcctccgtataggccagtgccagcagggcgttgtcatagagcatcttttcaaagtggggcaccagccacatttcatcggtagagtaccgggcaaagccgccgcccacatggtcgaacaggccgcctcggtacatgctctccagcgtctgctccgccatggccccggcctgggactcccctgtgcgccgggcgtaccggagcaggaagatcagattatgaggcgtggggaattttggcgcgtgcccgaagccgccccagcgggtgtcaaaactccgggcgtaaaggcccgccgccatgcctgccagtgcccggtctggaaagccggtgcctgcgccctccgcttccctgagccggtcggtcagcgcctctccggcggtcagcagactgcccctatcttcccgccacaggcgcgccgcctgctgcagcagggacagcagcgcctgtctggggaggtacgtccccgcccagaagggctcctgctccggcgtgagcagcaccgtcagcggccatccgccggagcctgtcatagccacgcaggcggccatatagaccgcgtccacatccgggcgctcctcccggtcgactttgatcgggataaaatcccggttgatcgcctccgccaccgtctcgtcctcaaaggactcatgggccatgacgtggcaccagtggcaggtggagtagccgatgctgaggaacaccggcttgtcctcctcccgtgcggtctggaatgcctcgctcccccagggccgccagtccacgggattttcccggtgctggagcagatacggggattgttcaaattgcagccggttgggcatgggtcgtcctcctttgaccgggcggcgcactgccgcccgcatggttccgcaggttttccgtccagtgccgcgcttgccccctgcttatacaaggcgttttccccatccggcacgggccgggggccgcagtttgttccgcggacttccgcctcagcgggccagatccggcgggagcggccgggcaaagcgcgcccctggtgtcggaccgggcaggtagattccggcaagtagcgccctggcccgccaaggtatccaggtcgtcatgccttcccccgccaaaaagtcttgcagtgggccttttcggtgcggttgaaggcgatcatccggcgcagcagcgtgtaatccacgtccctctcccacgggatgcggaacagcattttgccccggcatagccgccccgggcgatttcccggaaaaagccctccaagcccgccccggagaaacggccagatgcccggcggagacgctgatcccgacgatgaacgtcccatgatctgtgaacacaggctggttccatgcaaccctgagctccaggccggaaaacgtccgttccgcccactccagcacctccgccatacggacgcggcgctgcggcgctttcgcctgcgccagataatctgctaaggtctccaatccacccgccccttcacatccaaagagcagaaatagtctgtgcatttcaggagggattatcacccctcgcctcaagcagcggcgccccgggcggccgctcttccgtcaggacctgcagcctgttccggaaacgagggcctccttcaggttcatttcctgccctccttgcccaggctgatcttgtatccatcataagtgaaaaagggccgcacccgggcggaggtggaccaggtaactgcctgtctcaccgggtacacgctggcggacctcgcccggctggagcggtccagcgtcacctgcgctcacttttttcaacgtgcccccgccatgaatcctgaccgtgccctcatcaccgacaaggtctgcggtgtccgggtatgggacctgctgatacgggatatccggtatctgggcaagctggtggacgagctgcccaagggacccctatggagcagattctccggaaaaacaagtatgtcccggagcttctggcctttcagaaactcggggctgttttcgcctcgagagccctttgctttgccgccgagaaggggcagcgttttccgatgcactggctgtttcgggcactgtaagagcagacgggcacgctgtgctgcatctccacccccaggtgctcccggacaaagtccacggcagcctggacggccagccaggaatcccgtttgcagcaccgggggccacccaccttgccgatgctgtccagggcccgggcggtcatctgattgctcaatccccagggctcccgggccaggggcgtggatgccgtggcgatggccaggaactgccccgcgctgatccccgccccgcaggcgccccagaagccgcaggccccgccggggacagctttgccccggctgtacatctcccggagagcgctctccaggtccaacttgcccccggcatttttataggcggtgagcagcgccgctcccaccatcacatggtgctctggcccgtgcatatggcagaaggacaggtccatcatccggcggaggatagcggcggggtcggcggaagtctccgccaagcacaggccgaagatggtgtccatgccctgggtatggcagtcattgcaaacataatggccgttgacgcaccgggtcttgctggattcctttttatggcagatggcgcactccatgtcctcgtcccggaccagatattccagcggtgccttgcagatcaggcattcttctggatgcaaatcgatcactcctcccttatccgcagcgcaggaagtcacgcggctgcgcagtcccgacgccccccacaatatgctgtggggaaatgttctttctcataaatcggctccccccgatgcgttcatccacacatcagctgtgtactctctcctgttattttctatcatacaatagccaagataacccgctgaatgtaaaatccgcttaaggggagcaaacattttctccggctgtacatgcagtcattctatccgttcagcgttttccggaagcatagtcgcccatatggatgtccaccactcccctgggcggctggatcagggcatcctcgtactggcacttccactgaatctcccggctcatccggccattctctatgccgtcaatcgtttccccatccccaatggggttatcatgctccagtatgtacgacgccgcattataggcgtggttcactacccagttgggatccatgctatggaagtggtactggaggtccggcaggaacagggtgttcatgcccactgtgtcgatgagcatatcctcggtgccctcaatgttgaagaagcggacattgacaccaaatcggatgaagcggtccgagccctcgatctggtgggaacgcacatattccgccagcaagagcttgccgcagttctggaaatagaacgcctcacaggtggggtacagctctgccagggcctccacgaagtcggcgtccaggttggccctctccagggccggaagcgccgccgccagcatatcagtggccacgacctgataccggcactcccgaaagattcgctctcggtcctcccggcagtcccacatctggctcataaggaacgcatcgaagcccttgcccttgaatttgtcacatcccatcaccatcagctgcaccgggcatttgccgtcctgaaattccgcgatatgatccagggcagcaaagcctgccatctttttatcacggcagaaacactctaccgcgccgatgtgctttttcatcacagcggtcatctcatccttgtccggcatgtctaccggctctttgaacagcatttgaatgagataggggccgccgggctggggcccttttttgtcatccaggttttgccggaacacttgattactcatttttgtcctccttatagcagcagaccatgtaacaacgggcgatcgctactttgtatgcggggttactccaaaaatcaaaaaaagagccacactaaatagaaccaatccgatgaagttgcgctctatcagcagttttatggccaagagaagcagcagaccacaaaccagaataataataccattcatttctttttatccattttgtcagggaacagcttgaaccgaaacgccagttcctgattaacgatttccttgggcagctttcggggattggcgattagataccaagcccgataagtccgcttttccatgtcctgctcctgaaggtagatctgatagcccgcttcgtcctcctccgtccaagtgtcatactgcttcttggcctggacatggtttcccacgaccacgtccaattcctccacggagcggctggcggcccaagcatggtccacatcgccagcatgggagaaatagaagatttgcatccccatccaccggcgcaccttgctttccggcgttccacgcaattccgcctgacggcggtactccgccagctgctctggtgttccgtatctttccaccgcctgctcctccacatgaatacgccaactgtaatcctccggctgggtaaagggggcgcagaccggctgtaacgcctctgccgggtcctcctcaaagcggtcgataaagtcaaggtagcgggctttgattaagggcagaaaagtgtccagcaacccggtatccaaccgcaggtcctctgtcagcatccggaagaacgaaccgcctgttatcggttctattttgaaagagtagagaaagtcatccccctgcttaatgatgcagctgaatcccacctccacatttccatggccgatttcgtagtctatgtagttgtagcggctccgctcaaaccagatcaggtaggtcaggccgtttttcgttctcttttgaagttgccctttttcagacgcttccagcccttttcctccagccccagcccgttccacaggtagtccagaagctcctgaaatatatctgccgggcgtttttgttccataaaatcctcccaaccgcttatgcttgttcctcactttttccaatcacatccgctaattgagtactgacagtatctatgtagagatgcaccccatcccgatcacagtggtacaggtttgagtagcttgtactctcattagggcggatagggttaggctccaccacctcggtagcttccagcagaccgacacccagttccgccgcggcagtgagagcctttttcagcacggcaagctgtccgttactccaaagtccctccaaatcctccagcacctttgggtcctgctccagatcccggagaagctgtgtaacctgctttggagacaggtacacgccggaacagtagttttcaatgatctgattttctgccggatttggaaaagctgttggtgtcacctgtgcccatggggtgaaataccgggcatattccggcttttcttccaccaggaaagaaaaggcactgcctctggtgtaatagtaatcccggaaaaagccctggatcaccgcaatataaaagccgtggctcttatcaaacaattcatccggctctgtccccgcaccgacccgcagagtatccagatatttttccgcatagaagtcctccattccgtgctgtgcggcaagggccagcaccttttcctcctgcccctgctgtacccaggaaagcggggtaaaataccattcccgcatttcttccggcgaaatcgggtgaaaactgacatcgtatcccataaagctcctccttaataatccagtaaaatgggcacctgctgttcctcggcaaaccgcatggcccgccagaacatggagaaggcgaacttggcaagggactgggtatcatactgggtatgctccgagatgtccgccttgctgtactgtccatccgggcctacggttccgtctgccgggtatccctccgtgtctgcccaatcaaggatggtatcctcatcggcctgccacgccagctggttcagcttctccagctccttccgcagtccgcccaccgtgccgatggcggcggtgtcgtcggtaggcagaggtgcttggaagaagaaggcgtccggcagaggcagccaccaggtagccccacggaacagggaccatacccgctcctggtccgccgcaaggcgggcgaccaggggatgctccccgaagttccagtccttctccacagtgggaggcaccggttcctcgtatgtatggcaggcggccgccagcagcatggcgccgaaggcatcccaatccggcttgtcggtgtagtaggggctctcgttattctccggccagggagcgtagggggctggcccggctgagaaatggcgttcagaatctgatcccgccagttctccaccgccgcctggacctcggccggggacagttcctcctcgttgtcagcgggttccccgtccggggtgatgcggttgaaggcgtatccgttttcctccgcccactgctgaacaacggttttccagttgtgagaatagtaccgggtcaatgttccggcgtagatatcaagtcccattatgatgcctccttttttgtctgtacggtcattcttttgccggagcgaacagtcggtcaatcttctccagattgtattccaagatccagtcattgaattgatgatagagcggcagtagcagctcccgtgagccgcccagtatatccaacccacggtcatcgtacagatggtagaggaatggccccggcccggtcagatagacgctggacacaaagccgttccagccgccgatgtcccccagaatgatctcctggagaagccgctccggttgaaagctgattttgctgagatcccagtaaaactgtacttgtgcatatgtatccccgtcctcgtccatcatggtcgctgtgacctgctcatgcggggcaggaagtgcggccctctgctggatggccgtcagcagggactcgacaggtttttcttcgggatacccgtcaatccgcagaatacccggcggcgctggaaggttccggtagatcataatcgcccgctccagtgcgccttgaacataggcggggtttggagttagtttctcggtgttctcgtccgaataggtgcattccagatagactggttcatctccgccgatttcaaaccggatggcgaccggggcatgatggaacagcggatgttccagccacgccataccaagattatgtaagatggtgtcaaaatcctccgccagcattgcacacctccactatttccactcaaagggctcctttaagtggcatttctccataattttcttttccaaagcttcataggcatccatatcctctggctgcgctggaatacccttttcccaccaataaccgttcccatagtagaaaaacatggcccagtaataaggccggtcatggctgaatatcgccactcccacggcatcggccactggctctgccagcggtgcgcgttccactgtctgagaggcttcctcataggagatccccaccagctccaccagcaggtgcttcaccagttcgcagaagctatactggttgaagatgacctgaccattctcatctttgaacacaagtccatctctcaccatagtatttctctccgtttcttaacctgcatccttggcatgggcatagtcccgtcaagtcatctcatacagcagggcagcgtcgctctgcaccagctccagatgggagcgcagcgtttcaagtccgctttgcaccgcctcggtgggcagctcccagtctgcggcaatttcggcggccagctccgggaggctctgctcccgcagagttgccagcagttcagacgccagctctccctccagcagagcgcagtccagagtgttctccgtctggggagcgggaaatcggacatccagatccagctcgctctcacaccagtcccagatggccatgtagaccgcgccggagcagtcaccgttggacagctcctgccgctgaccgtctttgagcagataaaaggatgcgatctgtgacatggcagttcctcctgaatgttattctttctccatcagcccttcggcctgcatccggatcacatagaaagcccgtacccagtccagttcctgctccatggattcctccaaagccagcaggcggcgctttcccagcctgcggtccagaagggcgaggatgcggacaaggggattcttgctgacaaggcttttctcaatgctctggttgtcaaattcatgaaatgcctcatagaaaaaaccgttgtcaaaacagccatcgttcagtgtcccttcatgggccagccgaaaaggggccgttcgatcgtcctggccgatgccctcccgccgcagggcctgatatctgttccagtagttctgttcataggcatagtagttacttcgcagcacctccacgccgtccagtcgaatggctgcccggcctgtttggtcatggctttcccagtagctggcggcaaaatactggatgtgcccacggagcgtcgggcacaggtagtcattctccagcttgtttcggattccgctccaagttgacacaggtaccgcctcctttctgatgccactgcgggtaaggtggattcccaataaattgaaatttgaaaattacatataatcctcgatatatgatcgttctataaattcttttactgcaaatagatctgcaaactcctcatactggggaaatccgtccgcattatgtgctgagtaagttaaatggaacagatagtagatgtctcttcctgttccgtttctgagaacatataacacatcatcattggattcacacttcgcaaccgccaagatttttttgccgtataagaagtggtcttgtcctatttctttgtttagttctgcaacaaatgccccgtccgcctgtgcgaaggggatcatataccagttaaaatcgttaccatatttatcatagagatcacggaacatttcttctaatgtcattttcattcttccttcgctgatttacagttcagccatcaaccgccgcgctattttctttttataggcgatattttcattgctcattgagatacctcgccaatttcttctccagcagttctgtcatatcattgcagagtcgcttgaccttgtcctgctcatgggcgtagtaccagatggtttcctctccggggcggagcaggagctggtcgccatccgcttctttccagaactcgcccagcacacaataccgctctccatggatggttagatcaaacatcccggaaagtgaaaggatcacgcctgtggatacctggatgccagcggtcagcaggaagaactctcgcacctgggccgggagcgtgaagtccagcacgctttcttgacttgcgatctgctcctccgtggcggcaggctggatctcgtcagatggctccagcgcctttgccagcgccttggagaacttggggtaacggcaaaacagctcaggattgttggccttgaattccttttgctttttccgctgtactcgctcctgctccttgcagaaagcgtccagctccgccagataccgctcctggtagagattgctgacctcaaatgctgtgccgctcttttccagaatggcgatggctcccttttggctggtcagcaccgggacccatcggaagtcatgccggcaaggtttcagtttcaaaaattcgcctcggctcagcaggttttccagctccggctcatgctcgtcccaccagctccgccagctttcgggagtttcccgtccctcggccaggtccaggagttttattgccaatacttcactattcataggtcaattctccgtttcaaagggtgcaggaatcccgtcaatcccaccagaagtaccagacagtggactgccgcaggacatccgccagattgcccacggtgggatcatcctgctcctgatccacgatgtccgggcagaagccatattgctccacagccaactccacagctctttccttggggacaggaaccggaagttcaaactccatctcatcgtggctcatggcggcagggatggcgccgtactgctcaaaccagtattttgccactgccatcagttccggcgtgttggggcactcattccagttgccgaagggcaggtaggcgaagatctcccagggttttttcaccgggatcctggccaaaacgagggggtgggtcatgtggctgtccgaatcccagtagcaggagaaacggtcattgtcatagccgccagccatctcgcccagaatctcctcctcccagtccatatcgtcatcttcggcctctgctttgcgctggccgatcagttcctccagaaccgccttgctgtccttgatgggggcggagagcatcttcttccggtactccgttaccgctttgaggtcaaattcgtagcagtccgcgtcatgctccgggtcagcgttcatcaccagacactccagcagtgtttcgtcatccgccttgatgagcaccggtacaaatccctctttgacactttcccgtttggcatagctgtacgccgacatgatggggtcatcatctgccatggatgggaaataggtgcactcgcagtccagatactccatcaaagcatccgccacctcggagggctccagcgtgtcttcgtcaaagtcctgtccctgccagttttcaaagcgttccccgatcacctttgccatagcctgataataatcctcgtcaaagggaatgaacaggtaggcttcgtcccggaactcctcggagtgataccgctccgggccgaagaaacggagtgcgttatcgtcaacatcggcaggatagtaggggctgtcgccctctccgtagtaatagcctgcaaaggcacggccttgctgattgaacagcacagagaacagacagccgtccagctcatcccggataaactcccgcagatccacactggcaggatcaactttgacctgtttggccacttcgctgtattcttttaagaagtcctcgcccatcaggtcgtgttctatgcaccagcgcaggtagatggccatgtggttataggcattgatggggtcaataggcagttccttttcctcaatgctctcaaggtgataggaagcgtcatccatctcaccgtcaaaatcatcattggaaagggtgccacgagtgacagcatcctgacgggtgggatttacgacaaaactgatccccctcatcctgttcagcagagcgtcagcgtcatgttccagtttatagtccaattcatccgcataaagaggaatgacctgatagaagttgacctcctcgccgcccggcagagtgcagacctcactgccgtcctccgtaccctggggatcgatcagggtagcagtgcacagtttcgtgttttccgcaaagggttcccggttctccactgtatgaccatgccccaaccagctgtcacagttgatgggcagacgggccagggacttcagcaggcggatgggccagtaccaccgctcatctttcatggactcctgatccagcttccaatccgcaggcagtgcaatggccaactccgcccgctccagcttgtattccgccagttcctccggaacattcatccggtgggcgcccatgcccatagtgaccagcgtgtagtagtcccgctcccgggagggcggtaccacgcagatgtccacatggatgtccggggagaccagctcatggaacacattctcgaacgggccgaaatactgctggatgtgcccctcgacggcttccatctcctcctcggtgtagacctccggttcactggatttctcgtcttgaaagcattcctcgtccgggcagtcatccccgccgccattcgggtcttcaccgcctccctccggtccatccccgccggattcccaggagattttcagtgtcatctgctccttcggcagagagacaccgggactacggatgatggcatgcttatcgtccgcagaaaagccgatagtctccccatccttcagcgtaacatcacacgccagcacataggaggcaaggcttgccaaaaagtcccgcagcttctccggctcggcgtcagcgttcagcacctccatctcctccttgccgaacacatccatgccgtaggtatagccgttcaagccgccctcgctccggtacaggccgaaccagatccagttgaagatgggcagttcgtcctctttcatcatatcagcaaagccctcgtagaagcggggctcaaacaccacgccgctggtgtagataccggtggcgtattgttggcggcagcaggcagccgccagcttggcgaagagcttgcccttctccagaacctttttctccttgcccagcaccgccaccatgatatgggcgcggtgctcccgtgcgacttggacggcatcctcccacatgtagttgttctctgcgtttatttccgcttcgccgtcggggatgggataggtcgccagactgacagcagcgagcatatcacccacctcgaacaccagcgcatcgtcatccttctcctcactggcgtcgtactcctccacagagatgtcccatttttccttcatgtcccggatgaactggtccttgtcccattctcccttggacaggagaacaaagccggtgaagacacctgtgcggtcggtttcctccccgtcagcatcatcctcctcgaaatcgccctcattttcatccggatcgtagagggcttcatgctccagtccacggacaaattcctcaaagctgtctgccagatgggtgatcttgtagtcgttttcctgatccacatggactaccgcaggctctccctgggggccgcaagcccggtagtccagaaagatcatatcatgtccggcgctgggacagtcacagatggccacgccgatggcaggatacgcccactcgtcgatcatgaactggctgcccagctttccgcagagggagcagcttttttcccgtccgatgccgaacataccggtgatggccacatggtcctctgcccagcaggtgggctcatcgcagggatagcaggtgttcaccggaatgccgccgttgtgctgcttcatcagccagatgtaggaggcgggaagtttgtagcccagttcctcctccacgctggcgatcagctcatcggaaggcggatcactgacgtactctttcagcgcatacatactgtcgtcccagaaattggtgaggtcgaagccctcaaagggggtatcacccggcacgaatttgtccttcttgttccggctgctccggcgtttccggatctccgccttgcactcccggatcaccaccggagcgtcctcgtcctccgggtccagctccgcccaccgccgggcataggggatggcctcttcctcctgaccgtggagatactgatatccgtaggccatccgcatattccactccgccttgtcccggccttcctcccggacggactccagcacctcgatggctcgaagcagagccttgtcccccttgtagttgggggttccctcattgtggtcgcccagaattgcgtagttctccagcgcccgggccagggcgtaggcggtgcggtagttccgccagtcctccgggatggcattcaatgcctgaatacagcgggtgtactcgtcctcgtcgttccactgctggagctgtgcaaagaatgcctctgcattctgcggggtataagggatatagtccatgcccgtcggcgtctcgtccaactcggcggcctgcgcctcaccgtccggctcctcatcgggcggatttttcagactcacagtgcccgcttcacggcggaaggtatggaagctggcccaggggatgtcgctgtccttgaagaattcctttgccatctggagtgccgcccggatgtcccaggcgatgaagtccacatagccgcagtagagtccggtggctccgccggtgagggtgaccacctccgggccgtccccggtggtgaacacttcttccagtttgtcccggaagtcaaaaatcttctccgttccttcctcctcccgcagggtatccaggggatagcagaagaagcccgccgctgcgccgtcggcatggagctcgtccataaagtcattgtcggcattcagatagccgttgatgagcggcacacagttggtggagccagccatcacatccagccgccagtcggcgtccgggtccttgttgggttccattttgtagccaaggtagctctccagataggcttccggatcggtggaaagttccaagccccgctccttcaacgcgtcaggaagctgggacataagaatggacggctctgccttgggctcctccagcacatcgaagctgtctatgtatctcatgtggggatctcgcccagcacctggtcggtgagggtggtgagcatccaccagacccggccttcctcctcccggagcatgggcagcagcttttcgcagtaggcggagatggcgaagctgttttcgccctgttcctccagccagatctgcacatcttccccggagatatcccagccgtcgtcggtccgcaggccgatgttttggctgggctggcggcccaccaggatgttccagtgctccagcacctccttgggggcgtgcttccggaagtagaccagctcaaacagcttgacctcgtcgccctccggggtgaggatcagctcatgcttttcgccattgaagcccatctcgaaggaaatctcgtcaaagaccaagttcaaagtatcttccatttgggccacgatctccgcgccgcgggtgtgatccttgtcgtcgtccatcatctggcgcagctgggcttccatttcggcaaaggtttcccaccagtccactgtccgctcccggaagcactgtgaaaactgaggcagagaaatgctcttcttgcaccagtcgatcagctctatggtgtcctcgtcaccagggcgagcctccaatgccttttcaaagtatcgcagagcccggccctcctgatccagataaaagtaagagtaacccatgcggaagttccagcagtggtctccctcgaagtattccccatgggggctcaagagagcgatggcctttttgagcagcgcacggttggaaggtgcccccagattgttgtaggcccgggccagctcgctgtccatctccggggtgcgctcctgggctggaatggtctccagcgcgtcaatgatcttctggtactcgctcttttcattccacttctggcactgccttaaaatgtccatatctgggtcctcctcgtcctcatccgttttccagtctttgatctgctggaacacgccattctcatcccgctcaaaggcgcagggggcgggcgtatgtagcaggggaataatgtcgggatcgtcgttgcagatggagttgaggccgtagatcccggcgttgttggggtcgtccatgtactcgtcgctctcatcaccggcggtaaagcgccagccgctgtcccagtcgccgtccggctcctcccggtagcagtagccaaccttgcagccctccaccgtaatgcggctcgtggcgatgcagccattggcttcctcccagtctgggagcagattctgcatgtcctctgcctttacatagtagtcccggttgcgaccggcggcctcatacagctccttccgcagcgcctctatatcccgagccatctcccggatctcctcgtcatccatcatttcgtggagatcataggacagaggattttgggcaaaatccgccagggccttgttcattgcgtcatgctcctctggcgtggcggtgatgcggatacggcggtggggggtgttatactcgtccaggtcgtggaggtccacgccgccgctgacgctgcactccagcaggatggcggccagatcggtgaccacatcaatggcgaagtggaagtccatctccacgccattggagtgggtgaattccagataccccacagtctggcggaagttccagttctgcttgtccagcccgatcttagcgaagatctcgctgaggggcatctcctctttcttctggtcttctaaaaaggccacaaggttcaggctgtcatcggaacctccgataaagttgccccagtattttttgatatacatttgtcacgcctcctgttattccggccactcatcgccgtcacaccggctgatgaagtcatagtgcaggctctcaaagtaatcgttgggaatggattccccgtcctgacgaagctccagcccatccagatccatcatctcattgatatatgccagggtatcgtggatacccgcgatatgctcgtcctggagcatatcggccagcacacctttctgctccggggtcagtgtggcgagaagctcgtttttcgccttgttgtcctctgtcttgggaaaaccatcgcccttgacccaaagggcggtcatgctgtctttccgctccacaaggccgtcaataaatgcttgatacagttcaagttccttactcatagcagatcctccattctcaagcaaaaaattggctctcccagatggcctcaaattccgctttctctatggcgcaggcgcggaactcctcgccccagatatgggcgttcaattcctccacggttgggatcggcgtgatctcgatagcgccttcataaaggtcagggatattacgggtgcgtccatctgcaaagatgtcgatggagcggaggaccagccgctcattttcggtatccacttcatagaggatgaccggtggttctccctctggtgcgctctcccaaaagagcttgatgtactcgatcattccattatcctcatttgaaccaatgccaccccgtcatggtgccggttacctcatctatctgtattgcaatatcatcattgccgcgacagcccagcaaggccgcgagatgatcgttttccagaatcaaatcataaaactcaaccgctataccttggaattcctttggaatcttcagcgcagaaaaggaatccgctgactgagcattttggaaaaattcaatggccgttttcctgcattttactatgattcctgtttgagtggtcaactctttcatgttttctctgcctcgctcatgttcagatacatccccatcgttttttcatcggcacaggccgcccggatcagtttggccagcatcatcaaatcgtcgatgtattgggagtacacgcagaacacatcctcgtcggagtcgaagtgaaacagatccctgccgctgttgtttttctcgaactcccggatcacgccccggaccagccgctcccagtctttgctgctgccagtccgtcccagccggcagaattcctccacctggaacccgtcgctgatcttcagcaggagggagatcgcataagggtggtggggaatgagaaaaaagggcgcgatctgatccggtttgacccagatcttgaagggcgggcgcgggtcggggatccagggcaggatctcccattcctcctcccgccgatttccgtattgaaaaaggtccttcacggcttcacctcctgttccagcttttttctgcatttctcaatgtgggcccgcttggcggccagaatctcccgcaccgtctccgcctccatccgcagcagtagggcaattttctccgggggcatcccgtccgccgccagcatacagagaatctccttctgcgcggaggctttgccggccgcgaagccggtatcatagtcgtaagacagcagggcaaggaattgctccggcgtcagagtggaaattagtccctgctctccgtggcagatcctgctacgaagtgattgtacttcttcctgggatagtttagacatggactccccccctttccagcatatcaggaaccaatctgtcccgcatttaccgggcggaagatcctgcggcccgccagcagctcctccagctttttggccaacgcctccacaatggcgtggcagggattctcaccccccacgatctccagcttttgcagctcgacacagtggagcgttccatagatgcccagcgtgaagtctgtcaagtcagcaatcatttggtagccctccatgttgctcacatcggtctggccctctttggcggtcatcagcccaatgatccccaccgccacagtgaaagcaccgcagcaggactgctcggtctgcatgcccaagcccatgacagagaacatcttccgggtctcctcggacaaattcagatggtaatactcattgcaggccatgaacacggcctcggcgcaggtcagttccgtgccgatgtggtagtggttgaccagttcatagagtttcattgttgccataccatactccaatcgcaaagcatttcattctgtgtcactctgcgcagctcgtcccgcacctccatcagcgcaaagcccagcaggttttgtccgcgccacttcatcgggtcctgggcctccggcgaactggccgcgaggcggatgccccagatggcatcgtaggggctggcctccaccagcacgctgtccccggtggaaaggagaaactcccgcagttcgcggttctggctgaatttgtgccagttgccaagtagcacaatggcgtacttgaacttgtcccataccttctgctcaaagccccgcaccttgcggcccagggccttgatctgcttttggtcgctgcatttcaaaatctggtcccggatctctttgtcgccgaacagctcggccttggcagccatcatgtattgctccatgcagaggtagggggcagccgtcgtatagaagtcctccatccaccactggctgaggtagctttttgtcagctggccgtcctgggaaggctgatggccccagaacaggcacagttcccgctttcgcccggcggtaaactcctgctggagccactggcgggtgtactttggccggccttccggctgccacgcctccaccaggaagtcaccgtgtaccagcacttcgccgctgtcctcgtcctcccaccagcccttccaggttaccggctcgggaaagagggcgcggtattccgtccgctcctccggggagagggtgtccagccaatcgccaaatcggtatatgtaatcctcccatagcccatgcgccagccaatggagtatcgctcgatctccgggaaggccatccaagggggaggcatgattttcttatcttgtagtgccatagggttgtcctttcctgttagaaactgtcgaagttcttctctcacatccagcggagcgccgtccagggatgtgatctgtgccaactctgtttccgtcagatttttcaggaaaatgcagtattcatctgggtggcccccacaagctccattttaggcatctcgatctgctgtgggtcggtgatccgcagacaaggctcttccgttgcccaaaaccgggtcagagtaaaaacttggccgttgaaaataactttctgttccatcctcatccctcctgtaacttcttcagcagcttcacgatccgctcccgattctttgcggttttcatgaaggcggggagatgatcggcctgagtctttttcgctcttcccagcggcttttcccgcaggtcggcgctgagatagtcgatcagataggcaaggtgctcccggttgagtgcccaggccggtttgccctggaaggaggtcaaaaaccacagttccaggccgaaataaggttctcgtccgtcctgaatctcagcagtgtaggaaaatgcttcagctgttttatgaacttctcccgacatggttgtcccacaatagggacaggccacatggagaacagaaaagtgctgcttttcctcatcttcaatatccacccgatagtatcttccgcagtttttgcactggttatggacatcgtagcggtagatcgtccggtcacgggtctcctgatggccgcagctcaggcaccggaaataggcgttgtcatcatccgctgtcaccatacctgcgccgtggcacttggggcatttcacctgaatgccggaggtcagggcgttgtatgcactgtatgtaaagtagggttcatcaacaattcggctcatgcgcccgcacattcctttctatctaaggcccggcggacagcgttttcttcatgtctgccaagcctttttcatctaacccgtatgcctgctcaatcaaagtcccataccgatccgcatactgcgagaactctgcttcacagtgcaaatcatacagcaacaggcagccgttgtggaatacaacagggtcgggctccgcttttccttcctcctctgctaccagacgaagcacctcatcggcaatggcaagccgctctgatctgcctttgagctttgataatgccattcgtacaaaggcggcaatcacctcctgttcctgtagggcaatcgcggtcagttctttctgaaccaagaggagggctttttcatcccacatctcggcgctgcgtagaagatccgccaccagcgttcttctgttgagatcccgattttcccaggaaccaagctccagtagcagatctctttgctttacctgatccggttcgcggctccaatcaaacagccttgcccgaaaaatctggtaggctgacatcagttccaaccacgccgggctgtgatccttgccgaactctatcatgcttctcattttcctcaaaaatcccgcagctgctcaaacttctcaatcagggcatctttttggagtgtgttgtccggcagtgcgtccagaatcccccgcagggccatgtaaatttcatcccgctcctcggtttcgataaagcccatcttgttgaaggtctgggtgtatgctgcaaccgcatccagcgcctgggcctgggcgtcctcgcccggctcagcggccagtttcatcaattgggagcgggtcttgcggtattgattggctgcctttctcgcggcactgacaggaatatgctccgcaccgtcccagccccggaagggattgcccaggttttgcgccagccactccggtttccggggcttggtgatccgcaggtccattcccgccttacctttccagagctgctttgccgcttttgctgccgtctccggcaggctggtcatccagaaccagcgaagctccggcatctgctccggggtggggatgtcgtccgccccgaagccgaacaggtcgaaggtggaaaggtgcgtcagctcccggaactctcgcacagcagagaagttttgcagatttcccggcgcgccccagagcctcagctccttcaggtggggatggacagcagccagtccgctcagatcaaaatctttcagctggatgccatgcagttccaataggttcggcagttccgtgtgcgggcggtattccccgataaattggagggtcagaccgctgccatcttcgggggcatggatggtacaggcgtccggccccttgttctggaacaggagctgctctgtatcctcactcagccacagttcctgaaggcctgtcatgtccaacatcagctttctgatgctggtgccccgcagatcaagtgtcctctgaccgtggtccagcaaagtcagttcatcaacgaagggggttccccgcaaaaactccagcagatccgggtgccaccgctggcagatgaggtcggagaggcagggcagcgcctttagttccagcgccgaatcgaatggctcgtgctggtccatgatccgatggctgctgaccttcaccgggataccgccgatctctgtcaccccgtcgctctccgtggcctccttgaaggcccgccgccgcttttccgggatggcttgccaccggatctggaggtacacatcataaccgtcattccagccgccgtaggagcggcagggctggtcggtgaagggcggcagggtacccaccagcgtgtactggggcgggacctccaccggcacccgcagcagatgaaggtcacgggaccagtacatgaaatctatgtagagcgggcggagatgaggcagttcctccgcagtcagaggggcgtcacctgcccagtccagagagaggatcactgcccaggactccctgctcaccgtgtccggcggcgcgatataggccacctggcaggcggtgtagcatttcaagtatcgattgtagactgtatagacccctccggcttgtgctttcatacctgtgcctccccctgatagcttatagtcctattctctgccagccgtccagtcgctcctgcaccccgtcgatcctccagccctcgcccacacgcttcatgaggaagcggcggacaaagccggtgtttttctctctggtgtagatgtagagcttgtttcgggtgatctgctccgcgtccaggaactgctctcccttgtaggtgccctgggcgctgtacgagaggcccaggggtcggaagcccatacggggcttttcgctcacatacttctcccagatcaccagcaggcggggcacagcctcagcatcttcaaacccggcctgttccatgtactgctcccattctgtcatttcagcaaagaaggcagacaacaccctgcggcattccaccgccgcctgttcgtccagctggacgggctttttgcccttttcccgctggatttgagagaagtattccatctgctccttggtgaactgcacatgggccaccggctcgatgcggttgttgccggcgatggccagcagaccctcgtatgtaacggcggtatggtcgatctggatgtgggagagcttgggaatggaggccgcctggagcaaaccggcgtcgtccaacccggtgcggttgagggtgagaaggtccagcttgcagctttgcagggcggacagaccgctgccgtggatggcggcgttgccgtccaacagcagatagcgcagcttgggcatagcgaaaaaaacggggaaacaggcgtcagtgagtgcgccgtcttccacgccgaagttgaccatgcttttgtgttcggcgaagggggcaagcagttcatccgtcaccggatagcctttcacatggaagcctaccagggtgtaaccagccagccgttccatgagggccaaggtcagctccgggatctcaaacttcttctctccatccagggtcaggacaccgttttcccagtccgctgtccgcgcccgtttcggccattccatagctgcttacccccttacgcctgttcctggtagctggcttcaatgtcgatgaagcgcacgtacacggcgcagacttctccctttgcgtcatagccgaagtagacgggatagtagccgtcaccccagccggaagcgaagataggcagattgcagtccgtgtccggcaccgtccagttgagccagtcgccgtggctcaactgatatttgggacaggctttggcgttttcctccagcaagtcacagaacaggtcgttgtacggatcaatgtccgggtcttcctccagccgcttggcccagtatgttttgaaggccgcctgggtctggatgtccgcaacacagcccatcccggcgtctacgccaaagccaaaataaccgtcctcatccagttcctcgtccagatcctctttgcccgtcatccccaactcatagcggacaggcttttcccggctgacctccaccttgacgcaggcgtagcggtcgccgtatttttcactgggcaccacgcagatcttcacgggataagttccggcagggatcgtctgtataaagggcggtgtatcctccagctccaccagcggatcgcaggcaaagatcgttccgctgggaaaatggacggcgccgatgtccagcacatccacttccctattcccaatcactttctctgtgaaatgagcgtccaggtctgttttgcaggccagtttgtctttgatggattcatatttgttcagccattgtgttgcaggcatttcgatttctcctttcttttccagcggtatccggacgatgggccggtaaaagtcatagttgccgttcagtgcattatcctcctgcacttccggcttgcagtggggcgagcagggcaggaaaccaaggaacggtcccagcccgccgcagatattgcacccgccgtcgccgccgcaggtggtgagcctgtcagcctgtaccacttcccgcatatagggatcgtaggcgatggacaggccgaagaagttgggttcctccatgtcatagggccggttctcatcctcatccatgtcctcaaaccagtgcagacgcatggagtagtctaacccatctccccatggaaacagggtccgacatccgccgccacacaggtaggcccactcgtccgccgtgggcagggagaaaccctgtttttgcagccggttttgaaagtccggatagtctacctcgtgatagaggcttgcctgccagctgtcgccatcccgctcgaaacgggcacggcctaccagagtaagactgttcctgtcagtcaaagcgaattggcgaaaatcttccaaccattccgggcgcagccgtgggtcatccagcttgaccggctcccagttgatctcctccagctcccggcccaccagcatggggccgatggccgcccgccggacaggggccatgctctctccaatgagttctgtcgggtctcgctccatttcccattcccggaacaggtactccaattcctcgcggctttcctgattcagtcctgcggcaaactgttcccagcccagtatgacggtatcgccggggacaaagacgaactcccggccatcttttttgaagattccggtggtgcagtgctgtccccagcggccaaagtgctccatccgcacaaaatccaggcgatactgtgctgccagccgctccattatgggccgcttttcctccggggagagtcggtcaaactgagggcgaagcaggaggctttcggtatcggaaatgctgtttgcgccatccttcggcggctctggttcttcgcccgcaagaaagatgggcagattcgggtacacttctttgtactctcgccaaggttctagctttttgggcttgtttgccgtccgaagaaaaccccagaagtcgatgggataacgaaacaccggcccgaccctatcccgccgggtgacgatgaccactgtgccatcggtgagtattccaatgtgctgcattttctccccgccgaacattcccggacggatacgcagcacttcacgggtgttcatgttgatgagctgggcaaagtcatcggagaggatttcgccgtttccctgcaccagcaaccagtccccggtaaaccagcgaagtttcagctcctcgcccaggccgggcagaggggcgatgcgacaccgcccggtgtccatgtccagttccagcaggcattcttccatccgccacttgccactgacagagtgtatcatatagatacagttggtgccgggaacgggaacggcctcggagagatggtcgtatccatccagagagaaggtgtgttttgttaccttgccgttttcccagcggtagatctgtcccttgtaccactcgttggaaaagtagacccggcccagcccgtctgtcacgatgccacaatggtatttggtgctccatccatcttccggcaggggccagtttttcacatcctgacaggtgccccggtcggtgagttcaatccgtgtggcattggtgggatcgcccacccagagggagtttcccacccaccggagagaatggggcgccccctcgtatccgatgggagaaggctcaaaaaaattaagtgtactggggtttttgccaagcaacacctttccgatctgcccgcttgcagaggctccggaggcggcatacactccggcttgatccgaataggcgaggtgcccgaactggtacaggctcttggagcgggtcacttttggcgggcggcagcgcagatctgccacacagccgtatttccattcctccgaatggctgcttttccattctcccgctgcaaagtctcctgccagagagttgaagaaataatcgtactcatcttggagtatgtattcctcgcaaggcatcagcttcccagggtcctgctccttggcatggtcgccccattttcgtccttgctgtttcatcaggtgacaatattgcccctgctttttgcagtagcgttcccatccgctgcgttcttccgctggaattaggacaaacagatactcgtcctcctcgtccaggtcatacagcgcccagccgaaagtggacagctcctgtcccagcgcagccacgcccatttcgtggggtaatttcatatactgaatgccgagcgtatcaaagcgttcctccagcagcgccgggatctgcccgctccatttccgccgaagctccgccagcgtgtcctgtacggctccgtcaaatttcagaatgtccagcgcatcggatataatttgtgcccagtctgacataatagagtctcctatttcgagcgattcaaagttttccatccagtgcctccacaggtttcatggcagcggaatccaatttgcactgccgcagttcccgctcaatcagggcaaacacatccggaaagcactcaatctcatcctgatattcatatttcgcatacagtttcccgcactcggaaatccaaacctctgccgggtagtagtagccgatatgaccgatgggctgacatttttcaccggccgcctgttcgatctctgccagttcacagccggacatatcccgaaaataggcttcttccaaatggtttttgattccgttgaccaagtaaggaaacaaagcgaattgaaaatcagccgcccagttcagttttctctgctccaggtaccactcacagcacaggccgaaatatttacggtaaaaccgctgggttgtcttcatcatcgggacgccgtggtcggcgtaatactgctccgcaatggagatgtccacttttcgcccttcctgccatccggcgtactccatcagctgcttgaccttgcttttgaggtcgccggagatggggatgcgttctttaatcattcgaatcatctcctgtctgctgccaatcaaagatcctttggatatccgatcttatccaagcccgccttgatttcctccctctcgctgcgcgtagggttcaacgcagcggccagttcttttgtcaccggcaccccgtcagcaagctggcgcacagcttccaaaggcaggtcggcgtgataaaaccactttccgtactccacataggtctgtggattgccatcaatcgtggagagcagatctttggatgcgtcctcgccgtctatggggttgcagtgccaggtggagccatcctccgtccagacgcagaaggtgctcttcatctttttgacctctcggctgcccatgagtttttgcaaagcagagggcatcccatctgtcaggtcttcgacacggggaagtttttcctcccagtcatagagttcggaatccacaccgttgattacacagccttccggcgcaaacatgacgatcatgctccggtcactgccatcagtggcaaaaaacgcctctttgccctttcgccatgcggggttgtaggtatagtggcggatgaagctccattcctcctccagcatgatgatgtccagagccgccagtcctttgcagaagtttttcagacgctccgcattgggcaggccggataaatcttttgtggaaatcatgtggctatcctcctgtctttcgtcaccacagccgggcgatccgggtatatatcttattaggctctctgtccgtaaaactggtcaatgagtcggtgggttccgtaagcggcatcacattcaaaatgtccagcacataataccagattcctgtatcccagtcccggaaccgcccattgcagacagctctcccatactcaccgggagccaaatccaatgccagctcattgatgggctgtttttgcccggtctcatcgtaggtatatcgctccggcattgcaccgatgtgccaatcattgcggtaacgcacatggagtccggactccttctgaatcagttcaaaaggatgaattcgcattgagccattcggcttccattcgatcagcctgcgacagtccttatcgatctgaaatccattgggcctctgtaagatcgatacaaagtgtgtaggcaggccaaaggaataatacgagaagaagtctttcggcagccgcatggctctgggatactggttccgctgtgcggccgcatttccgccccggcagtctttataccattgcaggcggagctgctgaaccagaagtatgggcagatgctccaactgatgcttattctgtttcatcaccataccttcttccttgatagatccttccaatggtcttccatgtttcaggcatttacaactctgctgcaaactcataagaaaccgcaatgatgttgtaaacatcatcgtatgtaaacagccggtagtgccgatagatgtctttatcaaagtcctcccgcaccggcagagacttcagccaagtgctatcctcaatcaaatcgaaagaactgccatccagatgccccatcccagccagattttcataggtgtccaattcgcaggcaaaataggccagcacccgccggaaggtgagtgtgtagggaaaccagtctttttcgtccctgtgctgggagatcagatggccattgatgtcccccgtaaaggtcagattgttcagagcatcctgtttcacctggtccagatagatacagtcccgtcccatcaaaacacctaagcaagtgttaacagcagtcgctttttccataggtaactctctcctcagctctcgtgggtgatacagaaaatctcctggttcaagtcaaagtagaccaccatcagctcgtcggtgatctctgggttgaaggacaggtccagaatgaaaacttgctgattcatctcgctatccaccaggctgccgaaccgcttgagccgcaaaaagtccgccatctcggcaaaggacagcttggccgggtcggttcctggaaaaagttccgccgcaatatccgggcctacatcgtcccggtggaactccatgaaaaataccacggcatcgtggtaggggctgccctcgtccgccagcgccgctttgatggcagctttggccttttccgccaatctctccgcctcatccagcatttctcctaccgcatccatggcagcagaatcagcggtcagttctccctccacatcgaagagaaagggcagccccgattcctcgggaaagttgaatatctcctcgccgggtgtatatgtaaaatcaatgcgtttacagttcagcttcacagggatgcctcctcattggttttccagatggggtaatagaattggcgaatagactactgtatctccatcatgatccatcttgagaatgacagcaaattccgccacattgctctcctgtccctttgggagaggaaagatcattggggggcaacgcagggcagcatggttcgtggttttattccagtcctccatggccgcagataaaatggcgtcaatgtgtgccaataccttctcaatagaacccgctgatatgttgtaaaaagcggggtttttatgatactgctctgtgatgaagtttttataggtttggactggcataaagcaaaattcccaatcaaggggatacaacccaagccaatactcatacagtttcataggcgcctccttacccctcaatgttggcagctttgaggccctttttcaaggagccgtagaccgtcaccgcatggtcggtgaacatctcgtcgcagtcaaaccagacggtgaagctgccgccggaggtgacggacaggctcgtcatgctgatccgccgggcaagttcttcctctgtgatggggtctgttcccgggtcacgggggttttcctcatcctgggagagccagtcgttggccagcccggtcaggttctttgccgcaagctcccgcatggccttgtcccaggtctcgcagtcggccagcagcttcttggcggcactgcgggcacgggtccaggagggcttgctctccgcattgacctccagagacaggtacacatccgttccgcaccactggatctcaccctcaaaggtgttatagtccttgtccagcgtcagctcccccagcgtctcatcctggagcaccaccggcctgtggtactcgtccagaacggcctgaagctccgggcagtcctcgtgggccttgaccacctgggcgatacaccagggccacgccaccagatcctttgcccattcttccttcattcggcggatcttcaggcggcagatctgctccttgccaaagcgtccccagcccttttcgctgttacgctcctcgtcggtgaccggccaatccagccgctcctctttggtgctgaccttgccggtgtcacagaacaccatgcccagcgtcacaacagtcatttcccaaaagttgcccctgttgttatatccgcccccaatgcagcgattaatcagagcgaccacttcctgctcctcgggctcgtacatctcatagaattcttcaaacatcggcgtgacctcctttacagcagttccagcaccgcggcggcgggcttggcaaactctgccgggacttgctccaatatatcccggtaggcttccaccgactgccaggagtcataatagaagctgtaaaattcgtctgcggggaaaacctcgtcctcctcgtagcgcatctcatccgcttccccgtcgtattcttccgaccacagatattcttcccggagcagatcggagaactgcggcagcggctcggcgtgctccatctcatccccatcgcgaaagcactggaggatgccggcaaagaagtccagcagttccccggccaggaaatgggccacaggattccggccgctctctttgagtgctttgcccagaatccggctcaggaacaccatgccgaaaggcgtggcgtgccaaagggtcccctggtgctccatgttggtggtgagctcatagagagactctttgacggacgccaaatcacgcatctgctccagcaccgccagatgcgcgggaaaatccgtcccccggccataggcggtggtgagccggtgccacgggacatccgtgaccttgagatgggtgatgtaggtcctgttttcctctgtcatgttgccgccctccttactctgttgtctggctgcggtactccttctccagcgcggtgtaccaccgtttcagcatggtttgcagaccggttttccctttacgatctgtaaaaacgagaaacttctgcatcagtctggggaatagatatttgcccgcctctgtcagatcctgattgagatagaccatccgcaggatacggccctgtcgatccagagggttctttttcagcagttccttttcaaagcagaagcgcaggaatactgcattctcgtcgtagaagtcctccaccacagccgcgccaatgctggtatatgtgatgtcgtacaccaaccggctccagtcaaatttctcggcatagagcagtttcagtgcctttgcccagtgctcctccggaatcaccagcatcctgtgctgggcggtgctggagtagccacggtagacgggttccggctgtcccagcagttcactcacactgtcggcgtagacgaagcacagctcctcatcgaacaggccaccgatgaagttgccattgcagtacagcatataattcttggacttggctggagaataagagaggctatattcctgcgagaccaggcttttatgtaccttgttcagaaagtctattgatgtcatggctttactcctcaaactcgccctcaatcatcccgttcagataccggccgggatctgcgatgaagtcatcccatttggccagagggtggaattcctcatgctcgatatccagataccacagctttttgtccctggggctccacagcagcagatagtcgctgtaattgtccatggccgccatcagggagagcagcttcttccgcttccaggtcatctcctgcacatccatgaaagagtagagctctgcccacttcacccatttctgctccgggaactccagccgcagggggccggtcttcaagtattccaccagccgggcaggcagcttatagggcatgagctgccggagcttttcctgctcgttgtgccattcctccggttccagggctttcaggtagtcggccagctcctgattcttgttctgcaccgccacggtgtaaggccggtcgccgtatttgtcagcaatggtgatgtcggctccttgctcaatgagccagcgcaccatgggaagatttttgtgtcggacagcttcggtgacagcggtggaggcgttcggaaacaccatgtccggcttgtggtaattgatgtctgcccctttttccagaagcagccgggcaagtttggtattgccctcggacacagcggcccggaatgcctcgccgccaaacttgtccactgtgatcccggcttgctccagcaccgggatattctccgggcgcttgccccagcgcacttcctggaaggcccgctctttctgcttgggggtaagctgcgcggtctgtcccacaaagagtttcaccacctccggcccacaacagcgggcggcggtgagcagtaggggctgttcctctgccagactggaatcagccccatgctccagcaggaagtggatcataggcacatcattccgaaaaaccgcgatctccaatggcatcagcttgatgtattcgctgagctggatgggaacatctaaatccaggccaccttgaagcagcgcctccagcttgggagtgtcatggtcacagatggcggcagccgtttccgggagagtctcccagcggccaagataggcaatttcgtacatagggcacctactttctctatcctacaatggtggtttcctttacggccagattgtcataatccatagcaatcagtttttcggcggcctccggggtacacatgaaccaggtgctcacgccccaggcgtccatccttgtgacggtgaagaaatgggtttgggcagaagcaggttctcttgcgtcaatatagtagtcggagtagagatacaccagatcgacctctcgctccggcagccacttggcccggcgcacacgtggtttgccgtttttcagcgtcttctctctggggttctcaaaccacgccagttccttgagcttcagaccagtgaaggtatctatgagccgctgggcaatctcccggtgggtaaacaccccgcagttccaggagcccaccagccaggtctggataaagtctcccaccttgctgccgggggcgggcggcccgtagacgctctcgtccgcccacatgacctccagcttttcacattgatccggccggggacaggatttcttatcaccatagcggtacatgatattcacatagccgaagtcccggccggtccggtcatggccgacggcttccacttgataggcagttatggacatttcagctccacctcctgtgccagtacaaatccgcacagcccaagggaagcgtcgatgacaaatacccggatgtgctcccgatccatgcgctcccgcagttcctcgatgctgcaacaggcgggaaagccgtaagagacggccccgcccagcaggtctttgtactgttcaaaaaagccgtccacggtgatctcatccatgccgaagaggatgttgtcccggatcacattctcaaaccagtgggccagcaggccggtgaagtgaacggatacgttctctccggcctcagtccgggtatccacatgcaggatatgggcttcaaagtcagcgcaatagcacaggaccctgttgtcgtgcagatggtcaaaggattgaatcaccatactcatgccagctctgcgtccaaaatctggacttgcttcccttcctcgttcacatagtaaagggcgatataatcaatgccgtcccgcctgacctgctcccaaggcatccgctcaccgttgatcagttccacggtatccgccccatccggttcgaagtcctctttttcgtcctcatagtcaacgctgtaacccagctccaccaccagcttggaggcagggatcccataccgcttgaggggacggtgctccagcttggatggatcgtgtacatcgcagaacagattgtcgtagccatgccgcccaccgtcaaagatgacgaactcctcgccgctctccggatcacgggctgccaccagtccggggacctcatccccatctacgatataggattggggctctcccttcaccgtgagcagatctccgcaataccaaacctccagcagttccttgccggtggaggaacagagtgtcacggtgggcagacgcttctccgtccactctttcacatggccttccagccaggtgggatatttttcaggcatcatagccgttctcctcctatttcaatttcagcacaaatccccagatactcaccacgatcaggaggacacccaacaaaaagaaaaccacccgccggtatcccctgccgtggcggtgggcatcccgcgtaccggtggggtcgcagagccagttccagttgcggatcgctccgatcaaaatcactgcaccgatgattaccgaggcaatataccaatgctcctgtaaaaaagccgtaatctgcccgctgttcatttacatataaccctctttccatcatcgggagtttcccgccggataatctcctcccgctctttctgatctatctccaaggctttttcctcctccagatattcctcgcagtcccggaccagcttttgggcattcgggtcctccggggccaggtccagccagtgttttgcgtattcataggcggtggcggcggaggggtatgccatcagacaggaatagcccatcctggcgttccagtaggggtcgttctccccctgggtgcagacggactccaacaggtcaatggcgtgccggatgagagccccgtccactgcaccgtcggtcccatgcgctctatgatcccccagcaccgccagattgctgtaagcccggctcagcttgacggtcagaaaataaccccgctcctgctccgggatagcttcgatggcctcaatacatcgggagaactcgtccgcatcattccactgttcaagcagctccgacagctttgctgtctccgcctgattcatgacttcaccgcctttcccgtatcacccctgtatatccgcaccaatggggccttttttcagtgttccatccacagtgaccacatggccccagaacatatcatcgtcctcataccaagcggtaaaacgcccgccgggggagaccgaaaactcagtgagaatgatgcgccgggcgaactcatccccggtgatgggatctttctccgggtcccggtcggtctggtcattgtccgccagccattcgttggcctgagcggtgagcttctgggcagccatcgcccgcagggacttatcccagacttcctgatctgccagcagtttcttcatcacattggtggcgcgggtccaggacgctttcttttcaatctccacatccagcgagatctggacttcttttcccatccaccggcaggtcccggtgaacatactcatttcacgatccagcgtgagggttcccagcacctcgtcctccagaagaatgggctttgtgtattccgcccagagctcctccagtgccggacagggtacgccttcctccagtatctccgtgacataccactgaggttcgctgagggcatcgcctttccagccgcgggctttgatccggtaaatccggcccttggcaaaccgcttggaatagccgccggattcccgctccttgtccgtcagcggccagctcaggtagcatcggccggagatcacctgtccggtctggacatccgccatggcaagggcatgggtatgcgccgtccagaaagtatccagaaaggttttgtccgcgctggtaccgctctggatcagcaccagcttttccccatcttcctgggcgtacagggcaataaagtccttgaccgttctctttttcatgacgttctccttacgcaaatacctgctggtatttctctttcagttcctttggcaccgtcttgatgaccttgctgccgccgttttcagaggacgggccccagatggcccagagcaggctctgccaagcgatggcccggaatttcgggtccttgtcctcttccggcaggagatacgcggaaaagcggcgcttgactgtcagcagcgcatccaggctttccgcgttggcaatcaggctgcggaactcctttgcaggctttagattctgcatggacaatgcgccccgtaccaatacgcccagtgtccatggttggaaaccaaacttccggatcaaggcatgaaggaatttctcttgcagggaggagtgctcgtcatcgcagagatccagatactccgccaccagcggcgcccactgttctccttccagccccagagcgaacacagcaaaagagccgggcatggcgcaggcttcatccgcgaggttttggtaccactcatactcccgcatagccagacgagcgtatcgctctatagccggatgcagattggggtgttgcacagcgcaggcaaagagctgattgactcccttcttgggcaagccgggaatgggcagatagattttctcctttcctctgcactccaccgagtaactgcgggggaattcctcctgctccagcaccgcgcacaggtagtccaggatttcagcatagcactcctccgtggagtccctggcggtgatgcggatggtggcaaaggcgtcattggccgatgcggtgaaatgcaccgtcttacgttgttggatgtcctttggcaatttgccgctgccgttggttttcagtttctttaccatgtcgggacggatttgggaaaccaagccgaaaatgtgttcggtggtgagggattcaaaactctgcccatacacggtatggcagacagccacatagcaggcaaagcgcagcaatccttcgtccacatcctccggacgcaattccggccgcactgcgcagggcggaaagacggtaaagccatcttcccgctctcccacaaggaagcagcgttcctgcacctgcttttctatgtacttctccaactcatagcggatctcttcccagcccaccagccgccgcatggcgtcgcagatggaaaccgcatcctcgcagggaaattccttcagcggcagccgggaaagatgccgctccagcagctgattggggagaaagggcgttccgttatgatttcgcaccacggtcgggtaggcggcgtgattttcacgggcggcgccgctcagcacatcctgaatgcagagatccgcttccaccagcacctcagggtcagtatccggcttatggatcagataataacggccatgtacgccgtcacgctttggcaaactcatataggttctcccctcaggtctgctggtgctgcatggatacgatctggcagtccgggcagaactccacataaagcgcgccctctgcacagtcaaacaccgtatcccactggatctgggccaggtacttcatgggcttcccacagtgggggcaggtcgtatattccgcgtcctgcacccagttggcaaagccgccgatggtgttcacatcctcacaggccgcgccgtaaaacaggggcacaggcgctttgcccagtacaaagggattttcggtgagggccttgtagtcctcgggactgacatagcagtccatcttctccgccccgtcaaagagttcggagggaaagacctccacgccgccatccagagaaaagcggttgaaggcggggcctttcaggaatcccacgcagctggggcagcaggtggcggtcaggataccatccagccccaggaaccggagccgctcatccctgccatccaataccagcatgtccaccatacgcccgccgcagtggggacaggtgtcctcccgcgcccggccaatgcggacgggagatttctcgccagcggttcccttgaccataggatagcaggtgtcgaagttgagctggattttctggccctccttgttgaaggtccagcctccgatctgcgcatagctggatgggtccacatagaggcccttgcgccagggccggggatttcgctccagctccagcagcgtctccattgccttgtcatctccctgcatagcaaggcaactcatcaggttggaggcctcgctggaatattccgcggacaacagcgcatgaatcaggccatcccgcacatcggcgggagcgtgataatagatctcacagggccagaacacctctgcggccagtgccgcccgctggatctccggggcgatggcatcccggtcccccagcagctgccagaagtcggtgaactccgggtcctccatctccgccagcctctggatgttctgaatgagatttttctgcttttcgccaatttgttccggcgtccaggcaagagcagcttgccgatcctgctcgcacttacatttccagcacaatccctcatagcccaaagaggtcccacagccggggcaggcgtatttcaggctcatattcgttgactcctttccaaagacagaaagacgccccgcgacaccctgtcacttggacaggctgacgcagggcgtgaaaaggccgcaagaaagaagccacatctacccccagatgtggtttcctccacaggcaaaatccattttttatatagaatcaaagttatctttaactgattcgtgtgcatctccaaaaacttccgcctacatcacgcatgattccacgcgtatagtgtaagttgcttgtgatacttttatatggttagttgcttctcttcaaaccacaaggtcggatggttcttttccatcatacctaattacatggaaattatcaactaaaacttgcatcgataaaatcccagaaaccgctctctgttaggaaaacacatagatgatggctgacaactgcaacaggctctgcaaaggctatgcccagccctgcaaactaagctttcaggctgtggcggtgtttccctccattttcaaaagcataggaattaggattcaaaatggatagaggaactgtttgtggcactctttctttatagggcagcagaagacttccatgcggagcagcagggtgtttccgcatagaaaaatgccgaatttaaatctttgagcaggtaaattgagaacaccacaatcgaattagagcaattcgattgcggtgctcttttttgttaattacaggttaaaaagaattttttcttgcgttcttgtcagcagggccattgttgatgatataataaaaagcaatatacaccacacctgttaaaattaagaatttccgatatctgctttgctatatagcaataaggatcagttaataacagatgtatggagaaattcaaaggagcaaagtatgcgcaacctttttgtcattggaaacagatttgatcttgcgcacaatataaaacgggattcaaccattttagagactacttaagtgcaaactactcgatacttcacaatatgcgccatatgtaccagaagcaataacagagccattacggaaaagaactgcaagacactacagagatcgttggcttaatcgcatatcttttagacgaggctgccgcagacacaggaaaatgttttgataatgttgaacctcaatacgataaagaaggagaccgtatctattcttgggaatacgaaatgcagaatctatatgcgggaatatggcatgaacaattccatatattactgaactttccatggtaaaattcaaacttcccttttggtagacagcttgatattttattcaaagaggtgcatttgcgatggatatttctgtcctttatattattccgaatgaccggattattgaaactgtccaacgggttatgcagcgttgtgatgttaactatccggtatattatggaaccatgtccggagctttggaaattgcgaagcggatgatcgctcaggggagccgggtgattgtcagcaccggactgacggctctgtatttgcgcaagcatctttctgtgcctgttctggaactgctttttacaaatacggagtttgccagagccattcaggagggacttgctttttccgataagattctcatagttgccagtacctatgttaattattttgtccagcgcagtctggagttgtttcaaaatccaacccattctattcaggcggctgtgctgtctctcgaccgcccctttgaagagcaggttcaagaatatcttgaccaaggcgattttgacgtggtcatttcgtccacgcctggcgtgaagcaggcgcgaatcaacgggaaaatcgggattttgtttgacgttgatgaaaaaatggttgagttttccatacagactgcgcgttctttgctggattttgtagtacaccgcgcggaaaacgatcagctaatacacgctgttatgaattatacgcaagaagggcttattattacggaccgcgacgggatcatttcacagctcaacgcctctgcagagcgcattattggcactgtaaatgaggaagcctgcgggcagaatgccgaccagctgctggcgaatcgtcatattgtagattctcttaccaatgaaagtggtctggctgatccggaggcccatccggtcgttttgcagcgcaacacgatccaactggatggaaaatctgttggcatattactctccattcacgacatggcggatattcggatgctggaacgctctgccaaacgcattcatgagttgaacggccatgttgccacatggcgcctttccaatattattggcaaatcggaggctatttctcaggcccggcaaatggcgcgccgcttttctcagtacaacagcacggttttgatcctgggagagacgggcaccgggaaagagttgtttgcccaggggatccacaatgcgagtcctcgccgcaacgaaccttttctggcgattaactgtgctgccttaccggaacagttgctggaaagtgagctgttcggctatgtaaaaggtgcatttacaggcgcccgcagcaacgggaaaaccggtttatttgaagcagcaaatggaggtactattttcttggatgaaatcagtgagatcccacccaacatgcaggcgcgtctgcttcgggtgatccaagaacgtcaggtagtccggatcggtgatgacaaagtgatacccgttgatattcggatccttgctgccagcaatcgggatctgaggactcttgtgcagcagggggcattccgggcagacctctattaccggctgagcgtactggaattaaaggttccgcctttgtcctggcgcagagaggatattccgctactggcacagtcccttttacagaacaagaacaaggccctgaatacacacgttacgggatttgctcctgaggcgctggaagttctccaaagcctagaatggccggggaatattcgtcagctgtccaactttattgaacgcctgatgattttgtctgatccgccgcttattacgggggagaacgcccgcgcccttgcgcagaatgaggccacaaaagagctgcctgtttctagggagggccatttccctaccctggaggaagcggaatccaatctgattcgaaaggcattggatcagacgggaggcagccgtacagctgctgcgcagctgctgggtattcacccctcaactttgtggcggaaactacgggattttgatacagaaattcctctttgatgattgcataatgcacagtccccattgcatgatgcaactgttccagccgatttttgccttttttcggtagaaatcggctggattttcttatatggatatggcatgtaaattgctttatacttgtttaaagcgattgtgaattgctttgaagaaaagggggaattttcatggtatccgttggttgcagaatccacacgcatcccgcacgtacagatcccggtctggtggaacggtttcgcaatatcccggttgcgaatcttgacgactgcatgggacgtacagcagcgctctcctccgccatcaggccctatggcccgcgccggctgttagggcaggcatttactgtaagagtcccggcgggggacaatctgatgttccataaggccatggatatggctcagccaggagacgtttttgtgattgatgctttcggctgcgaagaacgctctatattgggggagctgatggtaagttactgtaaaatacggggtgcttccggcattgtggtggacggctgtatccgggacgcagacgccattcgggcgatgaatttccccatatatgcaaggggagttacgcccaatggcccctacaagaacgggccaggtgaaatcggtggagcagttgttgtaggtggacaggttattcgtcctggtgatattcttgcaggagacggcgacggaattgttgtaatacgtccggaggatgcggaggagattttggagcaggtcgaaaagctcatggccaacgagtcccgcactctcagtgagatgaagcagcatagtacatatatccgcccctgggtggacgagaagctggcagaattgaaatgtgaatatttatgaggtatccaaatgaaaatttttgtcaacgaacccatacatccggcagcaatggaactgctgcggtcacgggctgaagttgtctccgaatgggaggatgtcccggctgtcagcgcggcattggtgcggacaacaaaaattggacctgattttttaaatcgagcgaagcagctgcgcgtgatcggaaagcacgggatcgggtacgacaatattgacattgcatctgcgaaggagagagggattgctgttgtctatactcctttggcgaatgtcaactcggtggctgaactggcggtatctcttttccttgcgttggcccgaaagctggtttccgctcaaaaattgatacgttccggagagtgcaccaggatcgcgccccctgagctgacgggcactgagttgagcggaaagacagtggccctgatcggccttggacacattgcacagcaggttgcacagattctaggagtcggttttcactgccaccttgtgggatatgacccatatgtttcccgggaaaaaatggctacgctcgacattgagaaagcagattgtttgaaagaagcgctgagggcgggagatttgatcaacatcagcgtgcccctcaatgacagcacccgtggtatgatcggctccgcggaactgggcgtctgtcgccccactgcaattctggtcaatacggcacgtggcgggattgtagatgaggtggcgctctatgaagcgctgtcccgtaatgagctggctgcggcagcaagtgatgtttttgccgtcgagcctcccggtgtggatatgccgctgatgtctttacccaattttctgcccactccgcatataggagccaatacggaggaggcgctttatcgtatggggattacggtagtggaagatcttttcgccgttctgaacggtgtttctccacgatttcctgttccgtaaacggatgagataaaagaaaggagattcactatgcaacccaaaaattccattcgtcgaaagcctgcttttccggacggcatgttgatcgtccttggagtcatcatactgtgtgtcatcgtgacttggtttattccttcgggtcaatacgaccgtattttagatgccagcggacggcagatcgttgatccaaactctttccattatattgaaagcgaaaaaatcagtctcctgcgtattccacactttattgtagagggtacgattgcacaagcggaaatgattttcttcctgctgacgatcggtggctgctatgaaatcgtaatgcacaccggagtgcttcaggcgatcatagccagaatggccaaatggaaagtgcgggacatggcgtttatactggtctttacgctggtgtttgccgtgatcgcagctcctgctggcggtgtagtgtctttcatcggatttgcgcccatttttgtcatgatcgcccgggccatgggctatgatgcgcttgtgggcgtctctctggtgctgctaggaggtgctgtgggtgctgctgctggaccgatcactccctttaccacaggcgttgcccagggaattgcagaactgccgctgtattccggcctgtcttaccggataatctgcatgcttgttttgtggattgttacagccctctttattgctcggtatgctaaaaaagttcggttggatccctcaaagagctatgtttacgatcttgagcaggtgcagaagaatcaagaagtagaaaagcactatgacaccgatctttcggctcaacagatcgctattctggtgatttttattttaggcttgtgcctgatcatctatggcagccttcgcctgaactggggcaatcgagttcatatgcagatctatctgtgcatgagcgtgattcttgcgattgttggtaagttcaatcccaatgagacagtccgggtctttgtgcgaggagccaaggggatgctggccgcagctctggtactggggctttcccgcagtattagcatgattctggatgaggcgctggttctggacaccgttatttacggctgcgctgcgattttgaacgggcttcccacgttgctgcgggggccggctatgctgattgccaatacggttgtcaatgttttcattatttctggaagcgggcaggctgccgcagttatgccggtgttcatccctgttgcggatttggtggggctgactcgtcaaaccgctgtgctggccttcaatttcggcgatggcttttccaactggatccttccgcattctgctccgctgatgggatttattggtgctaccagcatctcctacggaaaatggtttaaatacttctggaagctattcctgctttggaatgccttggccatggcgcttctttttattgcacagttaatgaactatgggcctttctaaatgaaaaggagatcacgatctatgatgacaaaagaagaaattctgaatgctgcaaaaaaatgggaagatttttgcatcgctctgcgcagggatttccatgaatcccctgaattgtccgggcaggaaactcaaacaattgctcgtatttgtactgagttacgtgctgtgggactctctcccatcgaagtgcaagatggtggtgttttagcggtaatcgagggagatgctcctggcaaaaccgtgcttttgcgggcggacgtggatgcacttcctgttcaggaggatccgtgcaatcttttgcgcaagaaagaatgtgtcagcaagatccccggcgtgtcccatgtgtgcggccatgactgccatgcagccatgctggtcactgtggggaagattcttgcagcccgtcgggattttcctgggcgaattgtgctcatgtttgaacgcggtgaagaagggggcggcaatctccggtatctcattgattatctgcaaaagaaccattgggacattgatggagtttggggcatgcacctaaacagtgatattcccgcaggaaaatttgcgattcgaagtggaccgttgatggctgggggactgatgtttgacatcacattggtgggtaaggacggacatggttcaaggccggattgggccaataatcctgtggattgctttcagacgattcaaacagcattggataaaattcgtatgcgcgcggtagatccaaatgatgcaattaccttttcgatttgcagggtgtcaacggagtcccagcggcccaatattattggacgaactttaaattttgccggtacagttcgttactttgatttggaaagagcataccgtcctttcagcaaggcaatgcggcgaattattgataatattgccgatgcttttgaatgcgaagcagtatataatcagtttgagtgtattgcagtccctcttatcaatcaatctgattgttatgaaattgcaaagcagacattgacggagatttttggagaagatcgtgtagtgcaggggccattgaagtttggatcagagacactttcctatgtaatgagcttttggccgggtatgtatttgaatttgggtattaaagatcccacattgggtactggatccggtcatcatacggccaaattcgatgtagatgaatcgcagttcaaaaccggtgtcgcggcacacatcggatatgccctggccttcttggaaagctcaaagaaaatacaggatttcaagccttatgatggagatatttgggatctgttaggcgaataggtaaatggattttaaggagtcaccagaaaaacattgatatctattctggcacctatgatgaactgttttacagtagcggttatatttttaaccttgccctgtgcacagatgggcaggtcgaaatgacctctcggaagaattgggtactccattaacaaggggaagcccttgaaaacaatgttttatggagacattttctgcgaagattttcttgtttatggggatacccgactgttcaagcaggtcttcatattaccatccggttaaaaaaacacagtacaccggatgatggaggatatcttcccatccggtgtgctgtcttttggaatccactttaactgatcccatgcagtagaattttggcttcatatgcagattatggcgtggagatgctgaaataatccggaatatgcttggtaaacacactgccagagccaaattcataaaggattggaggcgtctcccttgtttcattttaaataattgttagtcagcttctctatccctaaaaacagaaggtggctacattatactcaagcaggatcagcctcccctcatcgtcaaagggaccgatgcccatgccgtagcgcatggggcttggctccctccgtgccagtgtcaagtgcgcccgcgtccccgggcgtttggccgggttccagaaccagagacgccctggagcggaaagcggacaccggatcttgatttcctgacagcagaaaatgtctgctttggacttggcggggatgcgcaaaagcttttgcgcttgcaggcgcaaagccgttgacattccagaccactgtcttcatgactgcagcccctccctgcccaccgaagtgggctttggcatgccccaagccggcagtataaaatctcttccagaaaaatacaatgcctgcccttgccgaatttgtcaagagcaggcattgttgtttcctccttgcagcggtttttcaggggcgttgcaattataaccaaaccagagccgaatgggggaagccttccgaaatttctccggataggacattccgcagtctgtgggggctatttttgccgcaaataattaccggcaacttggccagaaagagtcaccagagtaattcgtttctatattcggcttatgctggtaagaaactgtataacactgttgggtgaagagcagatgatgttgttgatcttgatgccatcagctgcgtggcctcaaaattccaggaggcagcccgcatatccataccgatctttgtgcggttgacgagccggggcagtaccaccagcaccgcctccaggaacggcgtgatcaccttcgccatcctggtagacggcttgacaacggtgatctggctggacgggccgggcaggcatctctcggctcattccccacgaagcagtgacctgccgcccaaaatcatcctaagatttgtacaagatattccattgacttgcctgtgtctctatgatacgtttgactcaaatttgcagcttacgacaggaggcttctatgcgctcagaaatcggagtcggcatcatcggatgcggcagcgttgccagatggaaatatgttaaaaacctggcagagatgtcaggcgtctctcttcgggccttctatggtggccgggctgaggagttccagcagcaatacggtgctccgggctccgcagtctgtcgagatctggcggaatttttggcccgtgaagacgttgatgccgtctgtatctgtacgccgaacaacagccatgcagaaattgccctggcagccctgcgcgcaagaaagcatgtgctgtgcgaaaagcccatggccatctccgctgaggatgccgttcggatggtcgagacagcggaacagatgggcgtcctgttgacagtggggcaccagtcccggttctctcccgccgctcaggccctttaccgccaactgcgggaaggcgccttcggctccctctactttgcccgggccagcatggtccggcggatgggaatccccacttgggggcactttttcgacccagcagtccagggtggcggatgtctgatcgatctgggcactcacgctctggatctggctctgtggttgctgaacgatttttccccggcctattgctgcgccggcatctttcgaggcccgggagactcccctactcccgccaaccgttggggcacttgggaccccgccatgctccggacggagaccggtgcctttggacaggttgtgctgcaaagcggcacggtgctgagtctggatatcagttgggcccttcacgtgccggaagaccgggaagagaccgttacgctctgcggcacagccgccggggcggagctctttcccggcggctatacaatcagcggcacacagggcgcccgcttggtcactacccgctatcagatgccggaggaggagcagagcgcaaatcgggcgcaactggaggattttttatcttccatccgggagcatcggctgcctctggtaacagcagcgcagtctttagtcgtaatgcagatcctatcaggactttaccgctccgcgcgggaacttcgtcctgtggaattttaaggaggatgcaactatgcacgaagaaaaagtagctctcaccaagaaccagatcgcggcgctccggagagcggcagagactcgttccattcaggacatctttgtagtggcctgtggcggctctttggccactctgtaccccattctgtacattctggatcgtgagacgaatgccgtccatgtatcctctgtcaatgcagcggaattcttccataacccgccacaccggttgggagatcacagcctggttatcttgaattctcaaagcggcacaacaccggagaccgtttccgccgcccgtttagcgcacgaacgcggggcgcttactgcggcgtttaccacagtaccaggctccgctatcgagactgtggtggattttcccatttactattatgacgatccgataaatccctatcctctgctgctctccatttttccggaggtttaccagctggcctttgctcttgtggatctgttgaacggcagtaattgtctccccggcatggaaaccgctatggaacatctggaggccgtatgtcagcgtgcggtttcagacttcgctcctcaggcccgggagtttgcccggaaacaccgcacggaacagctcatttacacggtctctgctggtcttgaccgatgcatcgcctatattctcaccaactgctcttttatggagtctgtatggcgtcattcctctcctcttcacgccggagaactcttccatggcgcctgcgaagctattggaaaagacacccctgttgtggcttttctagggctcggccgttgccgcccggtagaagagcgggctgtgaagtttctgcagcgggtcaccgataagttaaccgtcttagacgccgccgccttggatctcactgaaatcccagaggaattacaagagtatattgcgcctctagtgcttcactccctagcctcagatttctgtttacagttgtcccatctcaccggtcatcccatgagttcccggcgctatatgggcgtagtaaaattttaaacgaggtgtcataatgaaactgctgggactgggtgacaacgtatttgacgcctatttgtttcgagacgaactctatcccggtgggaacgccgccaatgtgtccgtactggcccgccggatcggtgctgaatatacaggctacctgggagtgctggcagatgatccaccaggtcgtcatttcctggccgccctcagggaggaatccgtggaagtcagccgtgtccgtattggtgtgggcaaatccgcatgtaactatattgtgttggatgaccatggagaccgcacgttctcaggaaataatggcaaagagaccgtgcaaaatcttttctctctacacctgacgccgcaagatctggcatatgccgccgctttcgatgtgatccacaccagtatccacagcggtatttccaacgcggtgctgggcggtctatcccgccgggcagatctgtccatggatttctccaatgacggctttactcacacaaacgtggcggaacttgcgccgatccttcgttttgccttcttctctgccggagaaaggtctttggaagaagtccacacttttgcaaaatatgccgccgactgtgggatcccccaagtaatctttactatggggactcgcggcgcttgtggaatctcccagggccagttttggcaagcggatgcctgtgttattcagcctgtggatgctttaggtgccggagatgcctttattgccgcctttttatatactttctgggaaaatggcggtagtgctcttttggcggcagaacaggcggcgcatttcgccgcagactgctgtctccactatggcgccttcggtcatccgctttctctggcggaaagcgacttgctttccacaggcccccaaaattagactgagaaaacaggctccggtggttttccaccggagcctgtttactgtactctttacggatttttcatttccaccaactcccttggcaacaggcctgcagcatcctggtccaaaagccagatacaattggggtgcttctggaggatggaggccggcagttcgttggtaaccggaccggtaatggctttgaaaacgatctccgccttttgaacaccgctggccagcaaaatcacaagctctgactccatgatctgagcgatgccctgtgtgatcccctcagcaagcggtaactcacggccaccgaagtacttcttctgtacagccttcgtcaccgcgctcagcggcgttctgtgcgaacgcagagaaaagtccaccccgttttcattaaagcccaaatggccgttcatcccaatgcccagcacctccacggcaatggggccataacggcggatgaaggcatcctgctctttcagctggcaatcgatggcagcaatcctgcttccgtcaaacagaaacttatcggcaaacgggcggtgcatgggagtcagcagttgggtgttcacaaagtgggagcagctcccctcatcctgaggcccgatacctacccagtcatccagttgtacaaacttcacccctgttggatcaatcattccgctgttgacgcggctcacgaactccctcagcatcccaaccggtgtatctccgcccggaaagctaaccaggcactgcgggtctttctctatggccttctgcaccaggtcagtcgcacaccggctcattgcctcataatccttttcaacaactactctcatgatttttcctcctctgcaactgtcacagcaatcatagcacaaatcgtccggcactgttaggacaattccatcctgatgtctggatttttttgttctctttttctggggacaaaaaaatcctagaaatctcacgagaatcttcattgtactcgtcctgtgatttggatagaataaagatgctatcgctatacaagtcatagtacacaaacagaagggagcatttttatggtcaaagttggaattatcggggtgggcacggtgtctcagatgatgcaccttcccattctcagcggccttcacgatctttaccagattacggcggtatccgatgtgtctcccacgcaactaaagcatattgcggagacttatcgtgcgaaagcctatgcagacccctatatgttggtgaaagcccccgatgtagatgccgtcttcatctgctcacctgaccagtatcacgcagactacgcccttgctgccattgaggccggaaagcatgtgtttgtggaaaagcctgtgacgctctgtattgaagatctggaaaagctaatcgccgctgaaaaagctcatcctgagcttgtgtgcatggtcggctacatgcgccgttacagccaaggcttcctgaaatgcaaggaactcttggccagcgatgatcgcaagattgaatacatgcgcttccgggatattattctggaaggcgacttctttatggatcagacccgtcctccctatctatgcagcgacatctccgacgaggtcaaggcggaaagttcctcccgccgccgggatcagatcactcgcgcgcttggcaacgactgcacggatcagcagcgcaccacttatgtgatgctcacaggcctcggttgccacaccctggccgctgtgcgagaactggtagggctgcctgtggaggtggaatctgtctccgtccagggagaacatgtcattattgttttccgatacaatgatttcttggccgtctatgagattctcaacgatcaggatgtggtgcaattcgacgccgccatcgagatctatcagcatgatcgtcgaatgaaaatcaagtatgagacgccctatctgcgttatcagcctcatacatttgaagtgattgagtccacaaagaaggataccaagaccaccctttatggtcctgattatcgcgaccccttccaggatgaggtccagtatttccatgactgcattgccaacggaaccacacctaagtccgattttgcagatgctatggctgatttggtactgttccgggagatctgcggcaagatcaaaaaatgatgaagagtacgctgcttcaagaatatattgcccagcagcccgccctgtggcgggctctgctggattcccgcgaggaaatcaccgcagaattttcccggcgtttcgggggatttcagccggatcgggtgattctggtcggttccggttcctctcactatgccgccctgatggcccgcccggttctagagcatgcctggggaacagaggtcacctgccttgtcccctccgaggcagcggatgcccgccttactgcagcacacccgctgtattttgccatttcgcaaagcggcgtcagcaccaatacctatgatttggtctgtcaactgaccaacgcaggcagggctgtgattgccgttacggaacaggcaaactctcccgtagggctagccgcctctctgtccgttcctcttcgaatcggaacagaacggatcggtgccaaaaccaagggcgtcaccgccactgtgctgacattaatgctgttagcgttgtctgtctgccaagacacgtcctatgggcagagaatgcttcaggccttggatcgactgtgccggaacgctccggaaaacctgtcccgttcccgtgcgtggagccacgcgcatcggaacgtgttcctgccgttccgtcacctgtatgtgctcggctgcggcaacagtctcggagccgcgcaggaaggagcgctgaagctgctggagaccaattatcttccagtttcctgctatcctttggacgagtatatccatggtatccaaaacgccctggacggcgatgcctgccttttgtgcctgctgccgtcccaagggccagatcgggaccggatgctgcgcctagtgaatttctccaaatcagttggggcctgctgcggcttgatctcccccagcgacaccggccagccggacgctcttcacctgctggatgccggagaagatgccctccagtccttagagtttcttcttgctttgcagacgctggccgcggagctttccgctgccagagggatcgattcctcccatcggcgctactcggatttcttctctatcatgggcagcaagatggagggagatatatgccagccaaagctctaaaccggcgctttttcctgctccaggctattatgatgctgatagactgcattacagtggcttacatatctcccattctggtctcctttggatactccaagctacagattggccaagtaatgacactgggtgccctagcagccacgttagcccgccccctatgggggtttctcaatgaccggttctcctgtgccaagcaggtgacattaggcgggacggcggtcgggatcgcctgttattttctgctgacctggggtggcggtcagatggggctgaccaccatagcggtaatggggttgtacatcactgtcgtctgtatgatgaactttgtggactcctgggctctccgtctgatcaacggcggtgcatccctgaactatggtgctacccgggcaggcgggtctctctcttacgctctcggtgccgccatcttcggcatggtagtctcacgctggggctttcgtccaggcaacgtggctctgtgggtgctctggattttgatgtgtgtggttgccctgtctttaccgaatcctccgcccgccagccatcttgaccagaagccggtcactctacttcaagggttccgcacactgcgatccaatcgcgtctattgggtgatgctggccgctctgtttctttgtactctggcctccgggtccatggagagcttctactctgtgctgattctatctgccggaggaacagagcagcatgttgggttcgccctgtttcttcaggccaccagtgagttgcctgtgatgtttggctacagtcggctgcgctccaggctgcatttgtcagcagcccccctgatggcagtttctatgctgtgctatgcgctgaaagccctgactctcgccagcgccggctctctgaatattatccttgttgcagccctgtttcaggcgctttcctttgcgcttttcacccccgcctgcgtggactttatgctggagactgtgcccggggagtacctagccatggggcaccttctgtttctggccattggtcagggtatcggtgccgtggcagggaatgccctcagcgggatcctatcagaatatcttggcatggcctggatgttccgcacggtcggattccttgcgttgctggccagtgtcctggcctgctgctccgcaaagatgttgaagaggaggaatttctcgtgatctttttaggctgtgatggaggctctaccaaaacagagtggctcctagtagaccacaccggccaagtgctggctcatcggatttttcccggctgcaactttgcattttggggtgaggacgggttccgggacctgatggtccgctctgttcagaccctgctggcagacagcggcatcacttctcagcagattacgtccgccatgctgagcctgactgtttacggagaggttcccggtaccgaggagttcttcccccaagtcatgcaatccatcctgcctgactgccctcttcagttttccaatgactctgtggcaggctggtgtggcagtctggccggccggcccggcatcaacattgtagccggcaccggttctgtcgcctatggccaagattcggccggaaacgcctctcgcgtaggaggctggtctctgttttttgcagatgagggttcctgcagctgggtagcccggcaaatgatcaccgaatttgtaaagcaggcagatggccggcatccccgatctgccatctatgaagaattgcggcaggagctgtccattactcacgatctatatttctccggatatctgcagacaaatgtccggcaggattcctcgctgttggcaaagctgcagctggttgtcttgcgggctgcacagcggggagacccagcagccataggtatctaccaccgtgcggctgaggagctgacggaaatggccactgctattcggcagcagttgaccttctccgcaggagagactgtgccagtctcgtactccggcggcctgttccgtgctggagaagtcatcatgactcccttccgcgcctgcatggaccgggagagctttgtgctgaatgaacctcggtacagtccggtgctaggagcactgatcctggccgctcgcgggttcctctccctggaggaaagcgacgccatggctgaccgaacggcggcccagttgacaaccgccccatccgtccaataaggcttctggaggttatcaaaatgaaaatcatccacgcaaaagattataatgacctcagccgcaaagccgccaacatcatatccgcccaggtaattttgaagccggagagtgtacttggcctagccaccggttcctcacctctcggaatttaccggcagctgattatttggtatgaaaaaggagatctggatttttctgctaccactgccgtgaatttggacgagtactgtaatctgccgccggacaatccacagagctaccacgccttcatgcgccaaaatttcttcgaccatatcaatatcaaccctgcccgggtccatattcccaacggcatggcctcagacttggagacagagtgccgccgctatgaccaattaatccaatccctgggcggaatcgacctgcagctgcttggaatcggccgcaatgctcacattggatttaacgagccggacagctgcttttccaaatatacgcacaaggtagcattgtcagagagcaccatcgctgccaacacccgtttttttgatcgggaggaggatgttcctcgtcaggccatttctatggggatgcaggccattactcaggcccgtaagatcctgctgattgccagcggtcccgataaggcagacgctctctgcgcctgctgtttcggtccggtaacgccacaagtcccagcctccatccttcagcttcatcaggatgtcaccatcatcgccgatgaagaatcgctgtccaagtgcccctccaatgttcctgtttctgccgccaagtgaaggagcagtcgtatacgtcaatactgggacggattaaaaagtcaaagagggtatcagatagtaaatctcgagaagtctaagggcttctcgagatttctcattttgagaggtgccgggaaagattggcgcgtgggaatggaaacaccaggcaaagccggagcatttggaggacgctgcaaatatcaaatggtggtttgaggaatgcagaggaggacacggctttgccgcgctctccagctgcgaagaatctcaggacagttcatccattgccacatcgggcaggtgtatagggtcaagctgccctctgttgcaacgttgagcgagtgaatcagcaaagtccctgtcatatgtaggccatcctccgggcgggctgctccaccttcagcccctccatcagacagcggtactgctgcggcgtcaaccgccgtacctccttttcgttttgcggccgttggtatgcgcctgctccagccgcttatagcttatacagcaggatgcatccatcccggtccctgcagaactccttgatgcagtcccgccgtctgccgcagaacagaaacagcgtgttggtgaacgggtccggtttaaaccgttgctgcaccatggcagccaccccatcgatccccttccccgacagttgcataacgccggagcattgtcgcttttcccattgcaggggtgtaaaacactcttggcatgcaaatttgttcatcgtgccgtttaatgaatattaagagcgggcaagcagaactgcttgcccgctctcttttgtctgttttggccgaagcggtcctcagaaattctctgaagaccgctctccgttttcggacttcgccttattggatgaggtggattttttgcagataggccagattcttcttggccttttcaaatgcctcctgtgtggtggcgtgggggcaatcctgttcgatgatcccgactccccggaaattcaaacgatccagcaaatcccggtaagcttcgtaatcaatgatcccatcctccagatcgcacataatatcatccatccggggatcatctggtgccagagcaccctccatctccatctttctgatctcaccagatacatttttgaagtggagatagggaatatgatcgatatgagcctccaggaaatccaacgcgctgcggtcgccctgcttccaattcccattggccgcagcatagtggccgttatcaaagcaaatgcatagatccagatcaatcagtcgctccaactcctcccgggtctcgatcagagagcgcctctccggatgcatcagaacctcaataccgtaggtgtcccggcagtaactgcccatttccccgaaaagcttataggtcctgatttgctgctccttgaggccggccttggtcttgcagtccatggcggttccgtccattgtcatcaggtaatgcacatcgaatgcctgcaggcgcttgcacaaatcatccacatcccctcggacatcggcaaaggaacgtgccttgagaaaatcatagcaagctgttccgccgcagatagaaaggtcccggcgagccagttcttccctcagttggccaatatctgtgggcagataccccactggtcccagttccagggccttatatccagcttctgccgcctggtccaaaaagatatcatacggggtgccagagggagttccatccggccaccagactccccaagaacagggggcagttccaattgttacttgcaagctcatgatttgatcttcctttccatttcatctgctccggagcgttcacggtattctttcggtttcaggcctgttgactttttaaaaattttagagaaatataccgggtcatagatacctacagcctccgcgatttcatatgcttttttatctgtggtccgcagcaaaaatttagcacgctcaaccctggtattaagaatataggtactcaaattctctcccatctcccgcttaaacagcttgctgaaataactgggacttagatgcaccatcgttgccagcgcatccaatgagagattggtgctgtaattttggtcaatgtactgttttaccttgtaaatgatactgtcgatattctcctctgtcctcccgatccgggacagggtctctgtcacatactcccgcacactgttctccagaagctccatgctcccagtgggcaaagccgttagctgttcggcgggcagattgtggctgaacagaagactcacacagaagttctgcaataaaagggcgatctgacacacgctggagaaaggaattttctgtgcttttatcaattggaagagatcctccatgtttttcagagccgcatcaccactgtgattttccagggcgctttccaccaaacgcaaccgctcccacagagcactggctgtgtcttcggacaactttggcaggtcctcacaccgcatgacggatggctggctactatacaacgcaaatttctgtgcgtcatccgcctctctggccgccttctgcatattcagtggatttttgtggaggcggctaattccgatcgtcagcaggaaatccgtttttccttctaccgcttctacagccgaagtgcagagttcagcggggtctattccctccggcaatgagagaactgcatagcagcaagtatcgctcttcggtaccaaaaacactgtatgcccctcgcagcaggacagtatgacctcctgcgcttgctggagcatcgctgtgcattcctccaaagttccccggaaaaccacctccaggctcagaacataataactgggcagcacaatgtgcaggtcattgagtttattgagaatgtaaagcagcgagtgtcggctttgaaaaatcagttctcccaacagagcctgctgttccagcaggaggctcttctgcacacggctttccttttgaagccgttggcatgccttgtccactgcagcggagagcgccttctccgtggtaggcttcagaacgaaatccgtcaccccacactggatagcctgttgagcatactcaaagtccggaaagcctgtaagcaaaatcatctgaatgcccggatagtgttcccggacccagccgcaaagttgcagtccgtccatctccggcatgcgaatgtctgtaatcagaatgtccggtggggactcctgaatttgatggacagcatctactccgtcgtttgcaattgctcgcacacagcagttgtgagccttccagtcaatcaaacacatcagccctcggggaattatcgcttcattgtccacaagcatcacagtgtacggcatggtttctcacccctttgtttgatcaagcggcaaagtcagcagcacggtggtaccctgaccgggtttcgaacggatctgcagatccgcccggtctccatatagcagatgcagacggcgaagtacatttgttagtgcaatatgattgtgctgtccggcactttccacctctcttgcgagatccagattttccggatcaaagcctacgccatcatcctcaattcgcacacaaatattctgcgtctcctcccacagccggactgccacgcttcctaagccccgccggggttccagcccgtggacgatggcgttttccaccagaggctggatcgtcagccgcggaaccaggtaccgcaaaaggtcctcgtcctcgtattccactgagtaagagagcttttccccaaatcgttctctctgtaaatccaaataatagtggacgtaaccgagctcctgttcaaatgtaattttctggctgcttcccacaccgatatttccccgaagcaggcacgccaggtccgtaaccatacgggaaatatttttcaatccagcatccacgcaacgcatattgatggtctccagcacattaaagatgaagtgcggattgatctgcgcagccaacaggcgtgattcgctctcctgcaatcgaatgcccttttgataggcatccttccaggatgcctccagattatcagccatctggttaaatgtagtttccagatcagccagttcccgatagccgctgtcaggcatacgggcggcatagtctgactccgccatccggtgcagcatcccctccattttctgcagcggatcccccagcactcgatgataggcgaccgcagccgccagaaccgtcagcagcacaatcgcgatacacagggctgagaaaatccaactcccctcccaaaccaaatcgtacatggacggaagtggtataaaaatatccacccgcagctcctcatcgtccacacgctgactgacatggtaaaagcggccctgccaacccggggcagttccttggagataggaagagttatcctcagtctgctccagaagttcttgcaggtcctccccctccccgtatagcagttttccctctccatctgagagcgccaagcatgtgtttggatagagttccgtcaagtctccagcattcagtaaagtatctacatcaatctccataatcagcttgcccaacggttccagcgtatcgatattcttatagtccagcaaaaaataggcggtgttctctggcgtattctctatggaaaacagcgtctctgctgaagattgttcgtttgcagcctcatagatactctgcattcggcgctgctcctgctcataggaccccctgggggagtaaaaggtgaacgccccatccctgcgaaaaaggtacacgctgtttaccgctccccgtttccaagtggattggtaagccgccactccccccacgacccgaagcaggtcatcccgtccctgcaaagccagatacatgtccaaatcctgcatacttgcacacaggctatcgtctatcatggcattatacgcgatgtcctgtgccaattccatagtgttggcaacagatgcagtcacttggctgatgtagaaatttacatttcccttggcctgtgattccattctagcagggatcgtacgatagaacaccagaagcatcagtagtgacggtcccaaaatcgtcacacagaccagtaaaaacattctgaccatgagagaccgcttccgcctgacatttccccgtctatgtgccatttccttcaccgcctcgggccgcctaacttttctcttgggttcattgtacaatgaggattttcctttttcaacactgaaatctgtaaatctcccgccctcttctctctccgccttcggcggcaaaaattgagcgaatttataccagaatcagagcaaaagagtcttaatatttgtagtcttttccgtgatatactgagaaagcatacaggaggggtgtagctatacccctgaaacgaaggaggaacacgataatgaagatgaaaagatggttgtcttgcacactggctctggccatgctcctcggtctgatgggctgcggcggcaccagcgatgaggcccccaatgatggtagcggctcctctgaagatgagattgtaatcaactatcccactttccagatcgggaccaacacggctgcccccgtggtggaggaattggtcagtcgcttcaacgaagaatatgcgggccagtatcgcattgaggttgaggagatccccggagatgccaattatgctgatcgaattcaagtccaaatctcttccggcaaactgcctcccgtggtctacggtggcggatacagcttgctggacttagccctggaagctgatctggttgtagacctgaccgacgtggtgaacgaggatcccgaatgggcttccatgtatgaaaacgacgcctggcaggctgccaactgccgcgatggaaagatctatgcttcctccaatgaaggtcagttgattggctacttctacaataaggagttatttgaccaggctggtattcagcccgctaccacttggaatgagttttttgacaactgcgacaaactgctggctgcaggcatcactccactggctatggacaccgctgacggtgcttgggtctccatgctgctgatgggcgccatggttgccaccagcggcgatgagggcctggagttcatgaacaccaagtatcccaccgactacaacattgagccggttgtcaacgctgtcgccgagatgcagaagtggtatcagaactacaccacgctggacgctgtgggcggcgcctatgagaacgcggccaacaacttcttctcaggcaacgtggccatgatctgcaacggcccctggatgatcggtgatttctctgacacctccaagacgcctgatggctttgatcagaacgtgggtgtggctgcctatcccggcaacttcgtctatgacgcccccattgaaggcatgtttgtcaccaagcaggacgatcctgccctggaggaggcggccatcgccatggtgaagttcttcaccagccccgagtctcagcagctggcactggagatgcagggcatggtccccgccgctgcctctgtggaaatcactgataccgctaccaccaacttcccgttgctgggcgagtttctgaacatagcctccgaatgcacggtacgttccaacaccttcaccggcaacatggttcccggcctacaagatctcttcagtgccgagttgcccaacctggccaatggcacctacacaccggagcagttctgccagatcctcacagattttgctgcggcaaacgccgtgtcctgatctttccgccagagatggcgtagacgaaactccggaagcccgtgaccgcaatctgcgcacaaaggatcgggttgccctagcggcagcccgatcttccctatccttggacaaggagatggaatttgatgaaacaaaaaaatggcgggtggatcgccctgtttttagcgccagcatgtatcctctttatcctgatcttcgcaatcccgctggtaatggtgttcgttacatcgctgttcgattaccgcctgctgccccgcaccttcacctttgtcggattttccaattttgttcagctgtttacggaggacaatcgcttttggcccatctttggcaacacggtcaagtggctttttatccattgcatcttccacgtgactcttggtacgctactagccttcatcctgtataaaaaacccagaggctggaaattcgttcgtgtgacttacatgattccaaatattatctcccagtccgctatcgccatgatctttctgaacttgtacaatgcccaatacggtgcggtaaattcgttcttgaagttggtcgggcttgagagtttacagcacaactggttgttcgagacggcaactgcgttcccgtccgtcactttgacttggttcctgttcgcaggatacaccaccacgttggtcctggctcagttgttgagcacggatgagagcttgatcgaggctgcggagattgacggtgccaccagtttccagatcgaccgtctggtgatgttcccggtggtcaagaaaatgatcggtaccacggtcattatggccgctacatacatgctacagctgttctccatgctctatatcaccaccggcggcggcccgggtacagtcactaccaatctgccgctgtatctatacaccactatgaaggccaacaattacggctatgccaatacaatcggagttgtaatcattctgttgggcttcatcactatgacgctgatccgcaagatcttcggcatgaataaggaagactaaggagagaatcggaatgttggcacattataagagaacgcctacccagaaggtcacccgtggattttcctatctgttcatggcactatgtgtgtgcgtggcgctgctccccattatctgggtcattttgtcctccttcaagaccaacagcgagatcttttccaatggcctgtccttgccctcccacttcggctttgacgggtatgtgcaggcactcgagatcgccccgatcctgaagtttttcgcaaatagcctgatagttgccaccatcacaacgattctgaatgtgttctgcctagctatggcggggtatgtgttcgccaagaagaggtttcgcttcaagaacacgatttttgccattctttccttgtccatggtgattcccaccacggcgctgatgagtcccgtgtacaatatcatcacaaagctgggcctctatgatactaagattgcgctgattctggtgtacacagcgctgaatatgcctatttctctgatggtgctccgatctgcgttcgcctctattcccacagagctggaggaggccgcctatattgatggcgccggctttttccgtacctttgtccaggtaatgatgccctgcgccaagggcggcttggccagtgcggcggtgctgacttttttggagagctggaacgagtttacctttgctctgctactcaccagctccacagacaaccggaccctgcccctgtccctgagctatttcaccagccagttcagttttaactacacggcaatgtttgctgccatcactattgcggtgctgcccagcatcattgtattcgctatcttccaagagcaggtgaatgccagtttgactgccggatcggtaaaaggctgaggccttctttttcgattccctttcagtccatggaaacccgtgtcccacaggtttgcttcctgttctgaacttcgttgaaaatccccggccttttcgataaaggaaaaggccggggattttgatgcgtttctggactcttagtactccagattgacactttctgtgttgaagatgtggcagatatttccgccgaaacagaagtccggttcccgcccgggagcaaaccgctccgtatagctcccgctgatattcatagtgggaacgacgatgactgcattctttcccgcagccatagcatgaagatggatcccattacccaatcatttcgaacacatctaccttggccaagatataacctccttctcccttccccaacatgatgtgattgggccgggcacccaatgtaacaggctgtccagaaatccctttcttggtcaagtcagcactcttttcaagtgacaactccaccttgatgccgccaagtatcacagagtaccggtctccttccctttgcagctccgcatcaaaaaaattcatctgcggcgtaccgatgaagttagccgcgaacagattggcaggatggtcaaaaacctcctgaggcgtaccgatctgttggatgaagccatccttcatgataacaatccggtcccccagagtcatagcctctgtttgatcatgggtgacatagaggaaggtagtattgatcttctggcgcagtttgataatctctgcgcgcatctgattacgcagcttggcgtccaagttgctgagaggctcgtccatcagcaggatcttgggttcccgtacgatagcgcggccaatcgccacacgctgccgctgcccaccggataaagcttttggcttgcggtccaggtactgcgtaatgtctaggatctccgccgcctcacgtacagctttgtcaatctcgctcttagggcgcttgcgcagcttcagtgggaacgccatattttcatacactgtcatatggggatagagcgcgtagttctggaacaccatagcgatgtcccggtctttaggggctacatcgttcatcaacttcccatcaatgtacagttctccgctggagatctcctccagccccgccaccattcgcagagtggtcgacttgccgcaaccagaggggccgaccaatttccccttgaatttttgtttaatataagcatttgatttttcatgatctctcaattcatgtgctcactcctcatggcagatgatccattcccattcggacagccctgaactgtgggcgctaccttgttatgacggccccaagtcttcaatcctttgctgcactccgcattatctttgaaatcagagcggatacgtccgtgtttcccgcctcgaagcacctttattcttgagccaggttgacaccgcaaaatgacgggaactccgagaaaaagaaagccgccgaaatcagccgggcctaagctcctttgatcatccggcgacttctattgacagagctattgataacttccccacctttcacttagacttttttaggaataatttttaattttctatgcttttagggacttggttctgcgtacttctttgggaaaaagcgcctatattacaatgttccagccttctatgccccaacatgatgaggtcactcaaagcgggttctcataaaatgaataaactggcggatctcccgggtaaggaatacgtcccgccgccataccaccgcgatgttcagcggcaacggcgggtccaccggcagggctatgatattctccccgggctcgatcacttggggtaataaaaaggcccctgccagattctgccggacaaaactcttgatggtcagcagttggttggaatagaacaacacattaggcgtcagtcctgcgtctcggaaacgggtctgcagcagggtctggtgataatatccgctggtaaataggattaaaggtgccattgcaatttccctcaactccgccttctctcgcccggccatgggggtgccgtagccggtgcagtacatcatggacatccgcatcagtggatgagcggccagtgcagcgggtggcgtttctcccacggcgatgatcgccagatctagctgaccggcgcgcaccatatcccgtgctgtatcagatcctgcttctgtcagccgaatgtgtacttccggacaacttccggtgaactccgcaaaaatcttggggaatagaaaaaaggccaccataggcggcactcccacggaaagagtgctccggcgctggctccgggcctgaaaatccgctgttaggccctccacttctgtcaggatgccatcgcagcgggccaaaaacgcctcaccatccagtgtgggaaccaacgtccgaccaccccgactcagcaatagcagccccagttcatcttccaagttctgaatagccgcggtaattgccggctgggaaacgtggagtcgctccgccgcccgggtaaccccacccaagtggcaaacggcggaaaagtagcgcagctgcatcagtttcatcccatggtgcctcccctttttaatatcgaaaaaaacgatatttaaataaatattatatattatatttaccatagaaacatctcttcggattgtttactgctaagtgctgttatttcaatggtttaagcagtagtaagatgtggttgaaagagtagaaatgtaggtaagtcatatattattcctacattatttctacatcgacattcctacacagaatacaccctattttattttttcgatttcttccttaagccagtcgaattctcgctgggtgtagaccttttcggtgatgtcggatatcttgtgaccaaccatgtatttgattgcatattcatcaacgccagcactctttgcggccgtgacaaagtgctttcttccgtcgtgaggacgatgctccgggttaagattaagctcgtcacggatcatctcaaagccggccttatagcgttggtagctcatcatcacagtcttgccgctgcgcttgtctttacagttgaagagatatgggctgccgatttctttggctttattgtaatgtcgctccacgaggtagcgaatttttgagtggataggtacgacgcggtcttcaccagcttcggtcttgatgccgcctttgaaagtgccattctcaaggtctacattggcaagctcaattaggccgagctcttgtggacgccatccagaataacactgaatgagtatcacatcaacgaaattcttatcgtcgacatgttcccagagctttgatatttcttcgtccgtaaaaggtatgtgctctttcttgactttctggatctctttgatcgtttcgtcagtcagcttgaatgtgcgcgagtagtttctgtcgacgatctcatattccagagcatagtcaagcatcaggttgaacaatgacttgatcttgttcttcatggatgcgctggcgtgttgctctttccctctgacagtggcaacaccctcgtccatgcagcctttcacatggcgggcacggacatccattactcgcatatcgtagacagccgagcaatacttccaagctgaagtaacggctcgtgaactgccatccgatttgagcgtcttgaaatactcttccgaccacttgtcgtaaagctctttgactgtgatcgcggcgccgaggtcgtaagggttcttgttatattctacgagcgctgcatacgcgtcattgtaagtcgcgaaatatgagtcaggcttgagcggtttgcaaattggcttgccgtcctgagtctttccaaccgtaaccatcgcccgaaagggattccgaaggttgcggttttttatttcgctgatttggccaaacccgttcgggaggcgtcttcgtttattgtttttggctctcggttttcgctttacagacggcttcattggatagccgcaatgagggcaagccggagccttgtcgcttacctgcaattcgcattcagggcattttacaagcatgagtttcacctccatagttgatttgtcctttgtaatcatatattatggtgtaggagttgtcaagatattcctacactttattttttgatggagcgatgcatatgattacaaatgatgtatcaacctgccccaaatgcggcggcgatttgaaatactatgaccgtgttactcggattgtacggacgaaagaaagaaagacctggaagatcccaatgcggcggcttcaatgcactcgctgcggttccgtacatagagagcttcctgaactgatatttccgtacaaacagtacgaggctgaagttatcatcggtgttttggagggcttcatcacctgcgaaaccatcggatttgaggactatccctgcgaaatgacgatggtccgatggcaagctcaggactggaccaccgaggttgttttaacaaagcgcagttgctaacttagaatagccgttgaaaggaggtaaacgccaatgaacgagcaagagttccctcaggggtctgtccccgtggctgttgcggcccgtgtgtatggcaaagatgcttcatgggtccgcgccggcatcgtctcagggtggctcccgattggcaaagccactcgcagcggaaaattagtcaccaccatcgaggagatggattcacgctatggccgtatcaacttttacatctccccaaagcgtctctacgaggagacaggatttttgtggaaaggagaacgacaataatggcaacggaaatccgtccggagctgtctgagaaaaatccgtactggattggcaagcaccggtattacgaactgaagcatttctgcctccagtatccgatttggaagaaagcctataatgctctgcttggcctaagcagccgtccgaacgaccttgatattttcgtcaagagtggccaagtacggagcgatccaactgcaaggtgtgcggaatctcgcgtatcctttgccaaacggatggaactggtcgagcaagctgccattggtacggacggtgacctctatccttatattttgcgaggggtcacagagggtctatcctacaatgccttgaaaatgcagtatgccatcccctgttgccgcgaggtctactacaacttgtatcggcggttcttctggctgctgagtaaggagcgtgattgagatgcggattgtgaatgtggcggtcagacaatgctatcgcttcaactgcccgaattgcgggagcaagctggaagctgacagtgacgagctggtcgatgtcggtggaaagaccagtcggttctggtgtcctgtctgccgagaagaaagatacattccatggtcttctctgagaaaacggacggtctacgaggacagttccgcagattaagcaaacccctttatggaaaggagtgtttttctatggacactatgtttgaaaatttagattttcggtttgataaggaaaataacgacgaacgaccttttatgattgcttgtaaagatcgagaaatcatggatggggaacgttgggtgttggtatctttatcgaccgatgaagcaaaaagattactcaagtatcttgaagaacacattgtaaaataaagaagattgagccgcttacaacggctctttctttttatattttccggcacgcgggtaactggatcagatgctaaattggtatctggaaaattgcccggggtaaaaatctgaaaaatcattttggaggtatgacatggaactcatcattggcattgttgtcggcattatcatcgggcttgtagtcggaacgcttatatttcggcgaaggtacattcccgtcggcgatcttcggatcgaccgttctgacccgacgagcgaaccatttctgtttctcgaattaggcacagatgtgcgcactatttctggcatgaaaaccgtcacgctcagcgttcgcaacgagaatttcctcccgcatgaataacaccccctattatggagccaacttattgaaaggagaaatgcaatatggcagaaatcaagaaattgctggatgatgcaatcgaaaccgagatcaataatctcaactcggcatctaacaaagacgagaaatcggaggccatcaagaacctcgcagcactgcacaagctccgtatcgaagagatcaaaacggaaactgaaatcgaggaaaagtcggagcgtcgggccatggataaagcagcccatgacgaagacgcgacactgaaagcgtttcagcttgacgagaatactctcgatcggtacgcgaagattggcattgctgcggcggaacttgtattgccgctgatgttctacggcgtttggatgagtagaggactgagattcgaggaaacggggacatttacatcccagacattcaagaatctgttcaatcgcttcaagcctactcgaaagagttgagccaacagcgttgagagtcgtgtaaaaaacacgctctcttcgcttttttcgtagattttgcagggcgctttatggaaaggagataccgaagagctctttatatctctcgacttaataccgggggtactgtataatagcagctacttccagattaacaggaggtaatgaaagtgcgcagaaaaggtagaaaggttattaaaccggcaggtagtgaattgatggactacctgaataagggatacgccatctgcaacaagtgcggagcggtgatggatcggaaagaagatcctgaaggcggatgcggtatttatgcctgcccgtcctgtggatgggaaattgaggaattggattatgagtacgagagttcagacgaaatggaactcggactcgatgaaagaggcgacgagtatctgatcttcagggatgacatgccgcccgcaggttgtaaagcttgcggtggtccctacccttactgcaaagcgtcatgcaaaatgtttgacgactaaagcattatcaacggaggagggtcctgtaacaggggctttcctctttttgttttggagatggagatgcgataccactatgaaaagcctacaatttatctttcaatgtacggaaagcgttacatttgcgaccatccggtctacgatagctgcacactgtttgaaatcggagataaaggtcttgctgtgatccaacagcggtatgatgccgaaacaaagtccacattctggacagaggtggatgcatggctgaccgatgccctctatgttcacccgaaattcaaggaattctttgatgaacgagccggaacttgtacggacgggctctggccaactgtaacgattcggcaaatcatgtgggcgctgaaaatgaagcctttgcaaaagcagcgttgggaaacggtctttgaccgccgtgatatttagcgccaatccagcagcccctattatggataccaatacctatgaaaggggttaggagtatggatgagatgaagattcaatcgaaattcatgacaggacttgtatcgaggatcgtaaagaaggtacttcggataaaattgggctgtgaagtagatattcagctcaatgagttccggacgacagtcattgacgataagactcatgtccatctggatttggatgcggaccttacaaaagaagaacttaacaaactattgaagactattggaatctgaggaattgagccgttttatgcggctcttttcttttttcgcagattttgcaactcatattatggagaaacagttagctcagtggtagagcgcttcacaaaaccagtgaagaggtgatcggttcgagtccgatactgcttctttactttttattttggacgaaaggagaaagcatgaacatcgagcaatttgaactgatcttgtgcgacatgtacaccatggatgcatggtcgcctccgcttctctggaaatggaaaaaagagttcaaggaggcaagtacaaagcagtgggcgatcagagagcttgagaactacattcgcaagcgactccatcatcgctccgatggatcggtcgacgaatttatcagattcacaaacgagttcgccatgaagatggctcgctattcaaatcactcaggagagaaccaagagatgcacgagatctttcaaactgccagttcggtcgctgctgatattttagatctcttaaatgcaatgaaatgaaaggagaattcagatgaaactcgaccctaagatcgggagaagcttgaagaaggcgtctcccaccattttgacatgcatcggagccgctggcgttgtggcaaccgcggttttggctgtcaaggcaaccccgaaagcggatagtcttatcaaggctgacagcaggagaaatcacgacggcgacccttatgctgcaacaaagctcgaagccgtcaaatcatgctggaaatgctacataccggctgcggccactggcgtcgctacgatcatctgcatctttggagcgaataccctcaataagaagcagcaggcgtctcttgccagtgcctatgcgctcgtaaaccgatcctattctgactataagcataaattgaaggaactgtatggcgaagatgcttacaagaagatcatggagtccatcgccgcagagaaaagcagtatgcctcctattacggctaccggaggcttctccaattcatctttggagtttgaagatgccaacgaggagcagcgactcttctacgacagcttctccaaaagatattttcaggcaaccataagccaagtcctgcaagcagagtatcacataaacaggaatatggttctcggcgcgttcgtaactctgaacgatttctatgacttccttggaataagccatgtcgaaggcggagatgttgttggctggttgctgtctgatagcatgtattggattgacttcgataactcaaaggctatggttgatgatggactgaacggagagattccgtgttatgtcgtcgatgctgagttcggccctcaaccagaatctgcgtgggattattgatttcccgcaaaaactacatcgcctattatggaaaggaggtcatgctttatgaaccagagaaatatctttaagctgctgtcccttgcgggagtcgtccttggcgggatcggaacattgttatccggctgggccgacaacaaggagcaggaagcaattatcgaggagaaggtcaacgaagcacttgctgccagaaacgaagaggaagagtcctaaacagggctcttctcttttttcgaggtgaactcatgacaaatgatgcggctgtacaagcacttctcgactatctcaacgaatcagatgaacccgaaatctattggccacgccatcactttgaagaatcttgcttttcgagatgggcggcatgggagatgatcgaggcaattatggatcatcctatggaagatccggaagatgtgatcgaggagttcaccatgaaaatggtgattttctcatctatcgcagatggtacggatgaaggactgatattttcgattgccgctgatttcgccgatgaatgcttgacactatttagagaggagaactcaaatgacaaaacaaaccattatcaatgcgttgaaaaacgcccagaagtcaataaaaaagcacagccctgagatcctcaccggcatcggaattgccgggatgatcgccaccactgtatccgccgttcgagcaacgccaaaggctttgcagctcatcgacgccagagaaatcaaggaaaaccggcgtctgagcaacaaggagatcgttgccaccacatggaagtgctatgttccggctgctgttacaggtgtgctgtccacagcctgccttgtaggcgccagctctgcaaatcttcgacgcaacactgcccttgcaacggcttattccatctccgaaacggctctcaaggagtacaaagagaaggctgttgaggtagtcggtgagaaaaaagagcaggcgatccgtgatgcagttgccaaggagacgcttacgaagcaccctcttggcgaacgcgaggtcatcattaccggcggtggtgatattctctgtttcgacccccttacaaaccgatatttcaagtccgatcgcgaccgcctgatgcgtgctatgaatgagctgaacaaacgaatgcgcgacgagatgcgtgtttcgctgaatgatttctacgatgagatcggtctgagcgaggccgaggtcggagagcatcttgggtgggacattgacaacggaaaaggctacatagacctcgatttcagcacacagttggctgatgatggaacgccttgccttgtcgtcggtcacaaccacccgcctatttacctttggtaagcgcagattttgcatctcctattatggagaaccaaacaacaaaaattacttttgaaaaggagaattttactatggaagacaagaaaatgaacgagatcgaggaaatcgaagctacggaagtcgacgagactcaggacagctctaatgctggtgccctgctcgccggtgtcatcggaggtttcattgcttacgctgtgattggcggggcgaagaagctgcgggtgatcatcgaagagaaggtcgctgcgaagaagctggcggaagccgctaagaccgacaaggccgaaatcgactcggcagacgaggattccgaggaaaactaagaaaagtaaattgcggagttctacaagggagagtgccaataacagggcgctttccctttttctttttatcaaattttggaggtgcactaatgcctgaatatcctgataactcgcatagcgcgagagaaaacacaagccctccctccaaacgggtggagaaagttgtcaacggcacagcaaagacccgcaagcagagcgaggtcaagaaatttgccggcatattcatgcctgatgaagttggcgatgttaaaaccttcatcatcacggatgtcgttatccctggtttgaagaacgccatcgccgatgttgtcagcattgttctctttggcgaagccggccgcatcggcactcggaagaacgccggatcaaaggtatcgtatcagcggtattatgacgatcctcgcagagatgaccgcagaaactacaatcagcggccgagacctgttgccgggtttgaatttgatgacatcatcttcgacaaccgtggagatgcagacctcgtcctcgaccagttggaatccgctattgccaactatggcatggccagcgtgctggatctctatgaccttgccggacttacttgccagaattacatggctgataagtacggctggactgatattcagagtgccagagttgcccgaacgagggacggctacatcttgcagcttcccagagcaatccaaatcacctaaaaagaggtgcagtcatgtacggatattttgtctcaagcgggtacagaggcttcgtcgacggaacatggatgctgttcccgactgagtccgagtattacgaatacatgaaagagctcaaaaactgagctgaaaactacaattaagaaaggatttattaccatgaaagctaatgaaatcatgacttccgcaaagcgtaccttctccaaggtcggctttgggctccagaagaagagccccgaaattcttgtcggtgtcggcatcgtaggtgctgttgcaagtgccgttctggcctgcaaggctaccactaaggcaggtgccatcgtcgaggagtctaagaactctctcgctgatattcgtgaggccaatgaaaacggcgtcaccaaggctggtgagtcctactccgcagaggatcgcaggaaagatctcgccatcgcctatgttcagacaggcgtgaagttcgcaaagctgtatgcccccgcggtcatgctcggtgcagtttctatcgccagcattctcgcaagccacaacatcatgaagaagcgcaacatcgctctggcggctgcttacgctgctgtcgataagtctttcaaggattatcgtgaccgcgtaatcgagcgtttcggcgaacaggttgaaaaggagctgcgctacaacatcaaggcgcaggagatcgaagagaccgttacggacgacaagggcaaggaaaagaaggtcaagcagaatgtgaatgtcgcagacgagaactgggatggctctgactacggcccttacgcaaaagtgtttgatgatacccactccgattggaagcaggaccctgaaatgaacctcttctatctgcgtgctcgtcaggctcaggcgaatgatatgctcaagtcccagggtcacctcttcctgaacgaagtttatgatatgctcggtttcaagcgcaccaaagccggcgctgttgtcggttggatctatgacgacaagaagccttacggcgacaactttgttgatttcggtatgaccgagattcgtcgtcacgatgctgattcggacgagtacaagcgcgcgttcattctggacttcaatgttgtcggcgacatcacttccaagatcgtcgaccaccagaatgactatctcgcatgaggacaagccgatgaaaaaattgcttatctgccttctcatcttcgtcggggcgattttcatatcctgtaactttgtgataaatgcaacgacgaccaaaacggttccggaacagcctatgattcagacggaacctctctctctgatcgtcgagacacctgctccatccactgatattttaccagaggaagagcctgcacccactcccgaacaagagcctttggctacgagggaggagatcgagcttcttgctctctgcgctatggcggaagccgagggagaatgcgagcagggccagcgactggtcattgacagcgttctcaatcgtgtagatgatccgcatttcccggacacgatctctgaggtcatctggcagaaaaaccagtatgcaggtatgtacggcgaccgtatcacccgctgctatgttatggacgagctggtaaagctcgttgaagaagaacttgaaaatcgtactgactacgatgtcgtgttcttcaatgcgggccattatagcgactatggagttcctatgttccaggtcggaaaccattacttctcaagctatgattaaaaggaggaacaattatgaagaagatcatgctttccctgctctcttataccctggcgactatgtccggcctctgcctggtgggcggagcagcagtcctcagctacaaggagtgactgacatggagggaattgcgaatttcatttccatgctcgactatgttcttgacacaaagcgtaagcgtcacatcaccggaggattgctgttgagtggcgctttactctttggcggtctggctatgaccgtcatgagcatccgagatgacgaggaggacgaagatgagtaaagcatctaccggctttgcctttgtggcaggccttactatcggcgcagcaggcgcctggtactatctgaaggataagtacgcaaaactcgccgaggaagagattgcctcggtcaaagcagcatacaccaagcgtgagaaaccgacaacggaagaaaaaactgtctcgcttgtaaatgctgccaagaacatggataagggtagcattaccgagtacactcagcgtttgcaggaggctggttataaggactactccagaacgattgacgagaagccctcgggaacgcctggtgaagttccgtatgtcatctctcctgatgaattcggagaacttgaagactatacgaaagttagcctgacatacttcgctgatggcatcttggctgatgagtgcggtgaaatcgttgatgatgtggaggaaatcatcggcgatgggctggaccacttcggcgaatacgaagacgattcggtgttcgtaaggagtgatgcaaagcgctgtgactacgagattctcaaggatctgcgtgatttcagcgacttcaagaagaaaaactttcctccgaataatgacgaggaggtctgaccttgaccaaaaacgagcttaatgatccatatttcgagtggatgtaccggctcgtggtcgacgaccgatattctaataagtcctaccggcgactgttctacaagctccacgacacggagtttgcatacacaatcccgatggacggcaaccgggccgaggatggcatcgagcttaggtatcggttcggtcgcgagcaaggctatcgtgatgctgtaattgccaactgccttgatattcggccttgcagcatccttgaaatgatgatcgcccttgccattcgatgtgaagaacacatcatggaagaccctgatattggcaaccgcaccggacagtggttctggagtatgcttgtcagtttgggccttggttccatgagcgatgttcggtttgatcctgttcgggtcgacgagattctcgaccgttttatggatcatgactacgcaccggatggtaagggcggtctgttcacaatccgtaaccctcggtttgatatgcggtctatggaaatctggtatcagatgaattgctatcttaacgagatcatcagagaagggagtttaacatgaatacgatcacgcatgatattttcgtgacggtcatgccgtctaagaatttctgcaagcagatgcagcggcaggctcgcagcacgaagatgttcaagttgattgcggtaggggcgatggttcttgccgcagcaaccgaggtggagcgcaggaagctggaggagcaggtctatcagctctctgttcgagtaaagaagttggagcgcagcgaaggagagtaatcaatgttagacttcttggtgattgcaacgcgcagtggcaagcgtggtatcatcgagatctatcccaagtttatcatcaagaaaagcagcgacctcatgattagaggcggcgatttctacgctatctggattgaggaacggggattgtggtcgactgatgaacaggatgcggttgacctgatcgaccgcgaactggaccgatacgccgaggaaaactgtaagcgttttgatgacaattatcgagtcatgcacatgtgggacgcggaaaccggaatgatcgacacctggcacaaatactgccagaagcagatgaaggaccagttccatatgctcgacgagaaactgatattttcaaacagcaaaacgggaaaaaagactatgccagcaagatgctgaattatccgcttgagcagggtgaggcgaactcttatgacaagctcatgagtgttctgtactctcctgccgagcggcacaaaatcgaatgggccattggttcagtcgtgtccggtgactccaagaggctgcaaaagttcatggtgctttacggcgccgctggtactggtaagtccacggtgctcaacatcattcagcagctctttgatggttattactctgtattcgatgctaaggctctcggctcttcaagcaatgcatttgcgctggaggcgttcaagacgaacccgttggttgctattcaacatgatggtgacctgtcccgtattgaggataatacgagacttaacagccttgtttcgcatgagctaatgacggtcaacgagaagttcaaatcaacttacgccaaccgttttaaggctttcctctttatgggcacaaacaaaccggttcgtattacggacgctaaatccggtctgattcgacgtttgattgatgtttccccaacaggagataaggtcgagccgaacgagtacaagaccatcatgaagcacatcccgtttgaacttggcccgattgcttaccactgtcaagaggtctatctggaagatccagcttactatgacggttatattccgattgctatgttgggggcctccaatgacttctacaactacatcgttgattcctacccagtcttcaagcgtgaagacggaacgtccctcaaggctgcttgggagatgtataagacctataatgaggaagcaaaggtctcgtaccccctcagccaacgagcgttcaaggaagagttgaagaactatttccatgactacacagagcgcttcagtatggaagatggcactcgtgttcggagctattacagtggcttcagaactgaaaaatttgaggaacagaccatcattgataagccggagcccacaactcggctgattcagtttgatggaacagtatccgcattcgacaaagattgtgcggactgtcctgctcaatatgccacatctaaagaaacgccctcgcagaaatggaaaaaagtcacgaagactctttcgcagttggatacctctaagctccactatgtcaaggtgcctgagaaccatatcgtcatcgactttgatattccggacgagaacggcaataagtgctttgacctgaacctggcagaggcgagtaagtggcctccaacctatgccgaggtcagcaagggtggtcagggtatccatctacattatatttacaccggcgatccgacaaggctgagccgtatctatgacgaccatattgaggtgaaggtcttcactggaaaaagctcgctgcgccggaaactcactaagttcaacaacctacctattgcaaccataagctctgggttaccattgaaaggagaaagcagcatggtaaacaacaaggtggttcagagcgagaaagggcttagggttcaaatcaagagaaatctcaacaaggagatccaccctgcaactaagcccagtatcgactttatccacaagattctgacggatgcgtatgaaagcggcatggtttacgatgttaccgatatgcgcaatgccgtcctggcctttgccgccaacagcaccaatcaggcagagtattgcatcaagctcgttaacaagatgccgttcaaatctgccgatgccgcccctgcggccaagaacgaaaccgctgacctcgtcttttatgatgtcgaggtgtttccgaaccttttcctcgtgaactggaagtttgcaggaagcacacaacctgtggttcggatgatcaacccgacctctgaagacatcgagggcctgatgaagttccgactcatcggcttcaactgccggcggtatgataaccacattctttatgctcgcttgatgggctataccaatgagcagctttacaacctgtctcagcggatcatcggcagcgaaaagaaatccaagagcaacaactgcttctttggcgaagcctataatgtctcttacactgatgtttacgacttctgctcgaaaaaacagagcttgaagaagtgggagattgaactcggcatccaccatcaggagcttggccttccgtgggaccagcctgttccggagagcatgtggcagaaggttgccgagtattgtgacaatgatgtcattgctacggaggcagtattcaatgcccgtaaggctgacttcatagctcgtgagatcctggccgatgtggctggaatgaccgtcaacgataccacgaacactttgaccgccaagattatcttcggtggaaacaagaagccgcaggatcagttcaattaccgtgacatgggtgatgccagtcagatttgcagcatggacgatctgccgttcaagtttgggccggaagaatatgacaactatacggcgtttgacaagaaagaccgtccgatcttccctggttacaagttcgataaaggcaagtctacttatcgcggcgaagaagttggcgagggcggctatgtctatgccgagcctggtatgtacggaaatatcgctctgctggatattgcttctatgcatccctcaagcatcatcgcagaagatctcttcggaccggtctatacgaagcggtttcgtgagatccgtgatgctcgtgtcgccattaagcataaggagttcgacaaggctcgtaagatgctgaacggtgctctggcaaagtatctgacggacgagagtgccgccgatgctctggcacaggcgctaaaaatcgccatcaactccgtttacggcctgacttcggccagcttcgagaatccgttccatgacaaccgtaacaaagataatatcgtcgccaagcgcggagccctgtttatgatcaacctcaagcacgaggttcagaaacggggctttgttgttgctcacatcaagacggactctatcaagatcccagacgctacacctgaaatcattcagttcgtcatggactacggcaagatgtacggttatattttcgagcacgaagcgacttatgatcgcatgtgcctcgtcaacaatgccgtttatattgccaagtacaaggatggtaaacacgccggcgagtggacagccacgggcactcagttccagatcccatatgtcttcaagaagctcttctcgcatgaggagatcaccttcgaggatatgtgtgagacgaagtccgttacctctgctatttatattgacagaagccctgatgaagccgcggcctatatcaacaatccggacatggcaatacagtccgaggataaccttgtacttgataatggtcatactttgcagttcatcggaaaggtcggactgtttaccccgattaagtccggttgtggtggaggttcactcgttcgtcaaaacaccgataagaacggcaatgtcaagtacgattccgtcgtcggaacaaaagactatctatggatggaatctgagatggtcaaaattctcggaaaggaagactgcattgaccggagatactatgatgctctcgttgatgctgcggccaccgatatttccaagtatggcgatttcgagtggttcgtttctgaagacccgtatgtttctgacacgccgccttggttcagccccggcgaaccccatgaagaagacagtacaccgttcgatgtgaggtaattctatggagaaaaacttcacaaaagatggtctccgctggtttacttgcaggcgatgtggactgagaaactgcgagaacatttatcggtggaaaaagaagccgcagcctatgaaaaacatctgcacccactgcattgaaaaagaggaactgacacacaaggaagctcgtgaacgagcccattatagtccattccaatatccgttttaacagttgagaggagtcttaattatgagtcgtaaagctactgacaacatcatcatcgaaaacgcccgcattatcttccggaacttttccggtaaggaggacaagtacaaccgtgccggtgatcgaaatttctgcgttatcatcgaggaccacaacgatgctcagcgtctgatcgaagacggctggaatatccgcgtgatgcctccccgtgaggaaggtgacgagcctcgccactatctccaggtcgcggtgagcttcaagaacttcccgcccaaggtcgtcatggtcacccgccgcaagcagacgcctctcgatgaggagtccatcggcgcgctcgactttgccgagatcagcaatgtggatcttatcatccgcccctataactggatcattcaggagggcaccaagaacgagaagagcggtgtgaaggcctacctcaagacgatgtatgtcaccattgaggaggatgagttcgccgagaagtatgctgcgagcgagtatccgcaggaataagcattgcggggacgctggttaggaggtagccggcgtccctttaactttttgaaaggaggaccccatgcctttctggaaacctaagaaaaagaagaaagcggttcataaggcgaaaccggctaagtcgctcccaaagtatgagccaaagccgttcattccgcctgagataccgaaaattgatatttcagcaaatcagcaaaaagagccacaaaagccggctccgaaaaaagcttcctcgccaagggcggacgacaagaagtatttcatcgagacattcaacaagctcgtgtccgagcgaaatcgaccgtgggacatttggaaggacttcgttctgatgacggcctgcgcattctccaatgctgttgataagacacattatgatgagcgagaagaccgttatctgaaagccatcgccaagtaccgcaaagaagagcaggcgttattcccggagcttcttgccgaaatgacggtcgcgttggagaaaaatccggaccaggactttcttggtgaagtctatatgcggatgaggctcggaagcgacgaacttaagcagatatttactccttataatgtttgtcacttcatggcgcttgcgacaatgggtaatgttgcggaacaggtcgaaaaaagcggctttatcaccgttcacgatgattgctgcggaggtggtgcaactttgatagctgctgccaatgtagcacggaacgaccttgaaaaggccggctttaacttccagaaccatattctcttctcggctcaggacatcgaggagacagtcgcgctcatgtgctatattcagttatcgctcctcggcgtcgccgggttcgtcaaggtcggcaattctcttaccgatccgatcagaaatggtgactctttggagaactactggtttacgcccatgtattttagcgatgtttggcatactcgtcgagttgtcagtcaaatgatggatattttgcgagaggaacgtgaaagcgatgaccattaaagattttgacacgaaaaaagtcattcttgaagaccaatacaaaagcgatgagtacgagacgatgactctctactttatcgcgccaaaagaatggctcgaaggcctctatcctgatgctgttcacactgaaatcagtgttgagtatccgctgaattgccccgaagcttatgcggcaaccgtaatggtatctccgacaagagatcttggagaggatggatatgaggactatgactggagtgaccttgagctgtctctttcagatattgaagcgttaatcgggatggctaagtcatgagtatcagtctgtacgatcatcagcgcagcgcccttgaaaaaatgaagaacggttgcattctatgcggcggggtcggttccggtaaatccagaactgctctcgcctattactatcttcagcagggcggaaacctcgatattcctgatgcgccgatgaaaaatccgcttgatatttacatcatcaccacggcacgcaagcgcgatacctgtgaatgggaggacgagttggctccattcctgctctccacccatgaggactgcaattactacaagaacaaggtcatcatcgactcgtggaacaacatcggcaaatacaaagatgtaaaaaacagtttctttatatttgacgagcagcgtgtcgtcggttacggagcttggacaaaagcattcctgaaaatcgcgaaagtgaacaaatggatcttgctctcagctacccctggggatacctggcaggattatatccccgtcttcatcgcaaatgggttctaccggaacaagaccgatttcatcgaccagcatgtggtttatgactggaggtcgaagtatccaaaggttgaccgatacctcaacaccggacggctgatccgtctgcgcaatcgcattctcgtgacgatggagttcgagcggcacaccacatcgcatcatcaggatgtgcctgtttcctacaacattccgctctacaaagatatttctcgaaaccgctggaacccttgggaagaccgtcctattgaaacggcttctgagctttgtatgaactggcgccgcgtggtaaattcggacgagtcccgaagcgtggccgtgctggagatcatggaagatcaccctaaagtcatcatcttctacaatttcgactacgagcttgatattctcaaaaatcttggttaccccgatgggactgaagtcgctgaatggaacggtcacaagcatcaagagatcccgaccggcgacaaatgggtttatctcgtgcagtacacggccggctgcgagggctggaactgcattaccactgatacgatcatcttctactcgcagaactattcctataaggtcatggttcaggcttccggacgaatcgaccgtctgacgacgccattcagtgacctttattacttccatctaaagagcttttccggcattgatctggcgatcagcaaggcactcaaggagaagaagaacttcaatgagggtcgctttgttgggtggtctactgcgccgatgccgaaagctgcatgacatgaaaaggagaaattatgaataacgcaaaaattattgctgtcgacttcgatggcactttggttgaaaacaaatggcctgagatcggtgcgccgattgaaaaaaacatcgccaaggttaaggccgaacaggaagctggcgccaaaatcattctttggacgaaccgcgtcggcgaacctttggaaaaagcactctcgttctgcaaggagcagggcatccacctcgatgctgtcaatgagaatctgcccgaaataacaaaagcatttgggactgactgccggaagatcttcgccaacgagtattgggatgatcgcgcagtcttgatgtccgagaaagatatcggagaattctctgacgggttccacactttcaattccctctatcatcagcggctcatcctcttcacggccttggtgaacactttcccgacgcttgcttggaaatcccacaagcattcggatggcgagactccctttggaggaggctggttcatcgttggcatcgacacgccaaaggggccctatacctatcattacgaggacaaggactgggacctgttccactgcaaagaggtggccactgcccctgagtgggacggccataccgataaggatgtcgagcgggtactgtcccttacggatgacgagagtgattgggcggctcgtgaagttgctattgcttctcagaaagaacgcgaaagtgccgaagataaagacgactgggattacggtgttgcgtgctatgagagtgccctcagagcgtatcggtctttggaacgcgacggccactccggtatgagcattcagatcaccaagagcatcctgaaccgcctcatcgacggcaaatgccttacccccattgaggacgatcctgatatttggactaaggtcgagtttggtgagaacgatcctatccagcacttccagtgcaagcgcatgagcagcctgtttaaggatgtcgccgaggacggtacggtcacttactcggatgtcaaccgtgttcagctcatcaacaaagaaagccctgatattccgttcagaaacggcttcggtactcgccttatcgacaagatgtatcccatcacgcttccgtacttccctgcggacaagaagttcaagatcatcgtcgaagagtttctgaccgatgagaaaaatggcgacttcgataccgtcggctatctccagcttattcttcccaatggcgaggtcgttgatctgaacggatatttcaaagatggtccggacggcatggttcgcatcgagcatgctgagtacgaggagcggaaagccaacaggatcgacaaaaagtaaccactgatatttgaaaggagaaagaaatatgatccccattgatacaatagtcagcattaaatccggtgacgagtacggtggtaaatacaccgggaaactcggcatcattaaaaagtttacagatgatcgggtcggagtggagtttgccggccttaaaaaccatgcaagcaaatacggcctcttctggttcaagaaagagaatgtgacaccttcactctttgatgtgccgaagcgcaatgatgcaatcattccggcggctcttgctaaggctttcctcaacttcactttcggagcccccagggcatcgctcggcgtaaagcaggtcattttcagtggtcctaaaacgatcgtgttctggctcgacggaaccaagactatcgtttcttgtggcgagggtgaccacaatgatccctatgccgggttctgtgctgccgttacgaagcgagtctttggctccacttctcaggcaaagaaggtcttggcacggacgaggaaggagacttccaaatgagcacaatttatatcggcgaacggcaaagtggcaaaacaaccatgctcatcgaaatgtctgaaaagaccggcgccaccatcgttgtggctacctatccgatggccaagtacattcagttgctcgctgctcagatgggtaagaaaattcctgttcctatcacggtgacgaactacatccgtcttctcgcaagtggcggccttggtaagagcgagaagtatctcatagacgagcttcagatgatgctctctgctatgaatgtcgaagctgctacggttgactgcgactgcattgaagttcttcgcggccaacagaaagaaggtttgtaatggctggaattaaaatgaatgttgagtttccgacgcgcctttgcgaagtcaatggtaagctcggatattttcaccgttgggagcagtggagcaaggttgtcgacgcaagccctcttcgtggaggtcatcctggcggacaaaacgggcaggtttttggaattgttgaattcgaagacggcgttcgtcgtgttggtccgtcttctatcaaattctgtgatgaggagaacgcgatactttgtgagatggcaaagcaccatgaggcattaaggaaaggagaagcaaatgctgaagattgaaaacgccgaagttctcggttgggaacacgccattcgaggcatgaggaaccctaagaactcatgggagaagagtgatagcggcccagaatgtccttatgggaaagaaaaatgttgcggagaatgccagcaaaatttctgcattggccccaacgataagcaactcatgatggccctccgcaacgctggtacggatcatcgcaagttcatgcggatgattaccgtctatctcgacatcaccgccccgctgtactggtggaaagagttcgacacctataaggtcggtacggtcgccaactcctgctctacgatgcacaaaatcgcagcaaaggagtttacactggatgacttcagtcacgagcatctggttgatgacctcgatgtccgtattgaaatcggaggaaccgatcacagagatacggggcccatggaagtccttggcatgacgattgatgtgctaaatcactatcgcgaaaaatatcttgcagcgacgaagactgaggaatacaccggcctccccgccaaggatatttggtggcagatgatccagcttctccccagttcctacaaccagaagcggacggtcatgctgaactatgaggttctggccaatatctacaaatcccgtcggcatcacaagctcgatgaatggcatacactttgtgaccggattgaaagtctgccttattctgcgttgattactggcactgccatttgacacaactccggctgttatgatacaatcataaaaaaagaaatcatgcgcaaaaagtacatcgcctattatggaaggaggttgttaggctatggctgaacgcaacgattctcaccttctggatggtggtgattctgtgggtatgacagataaccagtacaagggtatgctgcttgaccagttagaagactggcaggaaatccttgacctggcaatcgcagccgggaacaccgagattcagaaaaaggctgagaagcaaatcgcgaagatcaacgaaaagctgaaattctaatctctacccagagggaagggcttgtggaaacacaggctcttctctttttatattctttttgaggaggaagtttaattatgtcttgtcaatacaaagaccagtgtccaagctacagtggctggtgtaacgggccgaagcaggatttctccaagtgcgtggagttccttgtcacggcctatgagaacgagaaaaagcggatgatgcccaacgagtaccagaagctggctatacggacatgcagcatcccctacgaccagaagaaggatatgctcatgcacgctgtcctgggcctgacttccgaggctggcgaggtttctggtctgttccagaagaagtaccagggtcacaagctcgaccctgagcatctggaaaaggagttgggcgactgcctctggatgattgcggaggcttgcaccgctctcggctggaacatggaaacggtcatgcagaccaacatcgagaagctccgggcccgatatccggagggcttcgatgccgagcacagtctgcatcgcagagcaaatgatatttgaaaggagcttgtgaaaatggatgagaaaaaaatccactcaatcattgatgaagcaatggcggctcgtgaccgctctgtgtccatttatatttcgcctgatggtggtgtttctgtttcggtcttcccgtggccggacgaggagatactccgcaacatgagagccagcggtctgatctctcacaatgactaccggacacgacttggcctgtcgcctatgaaggactaaggaggatcacaatgaacgaaaaagttctaagacataaggaaatctgcgatgggctgaacgagctctacgcacgcaaaaaccacgactatggcgacagcttccataccactttcgtcgaggaaggtctcgctatggcccgtatccgtctgggagataagttctcccgcttcaagaccctgtctcgcctttcctgcaatgaccgcgaccagcagcaagttacggatgagtccattcgtgatacgctgctcgatctcgcaaactatgccatcatgactgtgttggagatggatgcaccagatgagagtcatgcgactatgtacgcttatgacaagccgttctatactgttggggaggataagtaagatgaaagctaagagagcgctttgtatgcttgcggcgatcctcctcgttgtcgccatgatgctgatgttcctgacgggttgtaatagacaagtaatcgacacgacattcagctatgacaatgctatcctggctcttcccgatggttctgtcattagcgggaaaatcgagagctggaaagactatgatgacggcgatcagattcaggtaaaaattgacggaactacatatctggttcattccgtcaacatcgtactgataaaggagtaatgattatgtggaagcgcgaactgatccgcaacaagatctatgcggtattgatggtgctggcatctttgccggttgttattttggagagggatggtacggtccttctcctttctcttttcttcggagttccgatgttcttcgcaaaagaaaactggatcatgggaggacccgttcatgaaagtaaagaaagccggaaaaagagtgttcggagccgtaatgtccgctgccgagaaaaaggctatggacatggagatacagcgacagctcgcagagtacgatcgaaagcatatccgagagatcgacgctctggttctgtgggagctacgtgaacagctcggcttcggcaacaagaggcttaaaaaattctatgacaacttctcccgcggcatcgaggctttgatccgtcgttatgagatggagcagggcgacgatgtctggctctgtacctacaagctgaaagagatcggctgtgatcttgaaaagtgggagaaagaaagaggtgaccaatgagcgaccgaaaaaactcggagggctactcagatccgacagcctaccaggccatgatgaaccttgaaatcgaggagcttcgctttaagaagttgctcaggtctatcaaggatgtgtgtgacttggcggacttcgagatcgaaggtcgtgtcgttctgatcgacaagcggtccggacggatatggaggtagaaaaatgtttaactttcctactgaagatattgtgaaggcattcgaggcctttagcgaagccatcaatcagttggctgctgatattgttgatgcgtgggaagctgtcaccgtgactgtatcagccgtcctcgacgatgatgcgctctggccaaaccgatacggaatgccgcctaaaaagtacggtcaatctcttcagaaacactccaaaaagtcattcaatcaatatgactacatcccgattatggcaaaaaatctcccttatcagcggagagcattttagcaaaactgcgtgaatttgccccggttctgtctaatctaagatagaattcggggctctttcatgcgcaaaaatcgtggccacttttattttgaaaaacgggcttctgcccactttctttcagaaacttgatatatttgggcgggttgagagacttgtagagacggttctggccaaaaaaagtgggtttttgcccggttttatttgaaaagtgggcaggctgaaaccgttggtacacaaggctttgcgggctttctgcccactttcccacttttttctttaattagtgtgaagaaaaaatataaaaaaaatatataagtgacgagaaaaagtgggtttttggccaaagcctgattttcctcaaaaaactctgacttccttttcgtgcgcgagtgtgatatactaagcttgcgacacaattaaatcttcttatccgcttcactatgggagaattacttggcaacaagtgtttctctcttaactcgttatacccatagtggtggtaagaggattgtgtcgcagcaatgagagatgcgcttttgcagggtgcgtctcttcgttggggcgcaccttttttatttgcactcttacgaggggaggacggagcgtggcacggccttacactgaacagcaagttctcaagaaactggatattccagatttcagacatttgacaaaagaaaaagtcattgcttttgcgacaatggttccgaagatgaaccccgaagttgcaaagaaagctcttgagcaatttccgaacttcgcttcgacttcacttgatgttttgaaagagtaccgcagcgtcatccaggaagcgatggaagacgatcgagagagtatgcgcagttgttacgatatgtataaccgcgtgatggattctcttgaaaaaatgctggataacgacgacctgacatttgagcagaagacttatattctcgatcagatgcaggaagttgccgcggcggtagcggataaggactctgaaaaatcgaggaaccgtttgaagctcattggggttatcggcggcgtagctgctgccattgtcgcggctttggcttcgagtcttggaggtaacatcgcactgaaagaaagcaacaacattgatgatgacaacataacggatttatgagaaaggacagacagcatgagtaaaggtaacggaaagcgtagcactggtggactgatcctcgatgtgatacttactttctgcacaggaggtctgtggctgatttggatactcattcggtatctgcgaaataatagctgaccctctggatatttaaccgagacgcttgaaaaggtgtctcggctttttttatgccctttttggcttccgcagaaaaaacagggtcttttatggagaagagagagatgtgttacacatttccctctctccattttattttttgtcgaaaggaggtcatttcgtggccagaagttccagacttgagagcggatttcaagaccgtttaatcgagtcattgaaagcgttgttccctggatgcatggttttcaagatggaccaaattcagggacttcccgatctgttgattctttatggcgagaagtgggcctccctcgaatgcaagaggtctgcgacagctaagaagcgcccaaatcaggactactatgtcgagaagatgaacgatatgtcattctctcgctttgtgtgtccggaaaataaagaggaggtattgaatgaacttcaacaggcattccaaccttgaaggtcagcacgccttccttggtgcaagtaagtatcactggatcaattacaccgatgataaaatcgcggactcctatgtgagatttctggcaacacagaaaggaactgttcttcacgcattcgccgctcagtgtattcttttggggcagaaacttcccaagtctcagaagactctgaacatgtatgtgaatgacgctatcggttataagatgacgccggaacagatcctctactattccccgaactgtttcggaacgaccgatgcgatttgtttccgaaataattttcttcgcatccatgatttgaagaccggagaaattgatgctcacattgaacagttggaggtctatgccgctctgttctgtttggagtatcatattcgtccagccgacattgaaatggaactgcgtatctaccagcacgaccaaattctgtaccataagccgactgttgaggatattctgccaatcatggacaggatcatcacagccgataaggtcatcaacaaaattagagaagaggagggttaagctatggacctcgtagaggaagatattctgatgcactatggcgtcaaacggcgctctgggcgctatccgtggggttccggtgataacccttaccaacatggcggcgactttcttgctcgcgttgaagagcttcagcggctcggcaaaactgaaaaacagattgctgatgaacttcatctttcgacgactgacttgcggatgcaggttcgcgtcgcaaagcatgaacgccgtgctcttcaggcagaccgtgcccgttctttgcgggaagacggtaagacgctggatgagatcgcctcaatcctcggttatgcgaatgactcttctgttcgcgcactgctgaatgagaatacggcagccaataagaataaggcgcaagccacggcagagattctgaagaaagagcttgcggaaaaaggagccattgatgtaggcaccggcgttgagcggcagcttggcgtttctaccggtgttcttcaagaggctcttttcattttggaaaccgagggttataaccgctatggcgtcggcgttccccaggtaaacgacccgaagaaacgcacgatcacccccgttatttccgttcctgagattgaccagagagaggtttatcagaaccttgaattggtgaagtctgttggcgactaccattctaccgatggtggcgagtcttgggacaagcgtgagtatccggcgagcattgattccagccgtgtgaagatcctttatggcgatgagggtggcgcactgaaagacggtgtcattgagatccgtcgcggcgttgctgaccttgatttgggagactctcactatgctcaggttcgtatccttgtagatggcactcattacctcaaaggaatggcgatgtattctgacgatatgcctgatggcgcagacattgtctttaacaccaacaagcataccggaacacctaagatggatgttctgaagaaaattcaggatgatcccgacaacccttttggggccttgattaaggctaatggccagagtcactatatcgacgccgacggcaatgagaagctttctgcgatcaacaagctgaaagaagagggcgactgggacaagatgagtaaaaatctttcttcccagttcctttccaagcagcccatccagcttattaagaagcagttggatttgacttacgctgatgctgctgatgagttctcggagatctgttcgttgaacaatcccaccgtaaagcggaagctcctgttagactttgcggatgagtgcgactcggctgctgtccatctgaaagcggctgctctccctcgtcagagcacgcaggtcatactaccgctcaatgcgatgaaagagaccgagatctttgccccgaactatcgtgatggcgaaaaggtcgtgctaattcgctatccgcatggtggtacctttgagatccctgagcttacggtcaataacaaaaacccgactgccgtttccgttctcggaaagaacattcgggatgctgtgggtatcaaccctaaggttgcagagcgtctttctggtgctgactttgatggcgaccaggtcgttgtcattccgaccggtgggagggtgaaaatccaatctacccccgcccttaaggatttgaaggacttcgatcctaagactgactactcaactgagggcaagactggcgttcggctccttgcaaagggtgctgctacacagagacagatgggtgagatttcaaatctcattactgacatgactctgaaaggcgctactgagcctgagatcgcaagagcggtcaaacacagcatggttgtcattgatgcggccaagcacaagctcgactaccggcagtctgagaaagacaatggtatcgccgagctcaagaagaagtatcaaggctttgacgacgagactggtcaccatggtggcgcctctaccctcttatcccgtagaaagcaggatgttgaggtaccggagcgtcagggcagcggtgtcattgatcctctgacaggaaaagtcgtttacaaggagtccggcagaacttatgtggacccccgtaccggaaagacggtagcagcaaccactaaggttaaacgcatcctcgcggttgatgatgttcgttcgatgtcttctggaacgcttcaggaagaggcctatgccgactatgccaataagatgaaagaccttgccaacaaggcccgtcttgaatacaaggctacccctactctgaagcgctctgccagtgcggccaaggcctttgagcccgaagtgaaccgccttatggctgctctcaaggtcgcacagttgaatgctcctcttgaacgagaggctcaacgaattgcaaatgctcgtgtaaaagcaaaggttcaggcaaacaacattactgacaaagatgagatttccaagatccgtcgtgctgctatcagtgatgccagaaattctactggcgcaagcggaaagcgaactcgcattacaatcagcgatggtgaatggactgcaattcagtctggtgcaatttcagacacaaccttgagcgagatcttgcgctatgccgaaccgaaaactgtcagagaacgagcaacgccgagaagaacaacgcagttgtccgatgctcgcattagcagaatcaaagcaatggcgaattctggcaacacaaatgctgaaatcgctgaagctttgggaatttcgacttctgccgtttcaaagtatctgaattcatgaaaggaagtgagagaaaatggctcaatcatgcgcgctaactacgacagacaatccgtatgatccctttacccagtacgatgcttggtatcgctttgatgaaggcaaaggctatcactcttgcgcctatctggcccgtatagccaggacctccgatcagctttcagatgctgaaaacgaacaggaacttgagcgtgccattgacgacatcatcaaatacgatccccttgggatctacaaaaagtaaaagcagacacaaaggattcgccttccgtgagtgcataaaggctttagcagcctctttcgctcaaatcgggaggctttatcttttgctctgcttttacaacacgataagttttaactccaagtcaccttttgcttagcgagattaccttgctttctaaaaggtatagggggggtcgcaaaaacagcaccccctctgcatcgcggcggtctttgaaaattctccgggggatatttttgaaaaatgtttttcggggttgggggcagccggcgggagttttgggcgacgagacagggtttgaacgggcccacagggctgatatttcacctcctgatgtgttcttctttccatggaattgccacgaccgggtcatgcaagtgctttctctacctccatctttcatttggggatttctcctttcaacttgttcagccagtcagttctgtgggttctttcaagccctgtctcaaagtccaaataagtgatgcaaaacacagcgaataccatgatcaaacacagcgagaggaggtggcaaggatggcaaaggccgcaagatcatctgagaaagtacctaaatcccgtgcggctcttactcctgaagcaagagagaagcaactgatcgccttagccattgatgttgccgaagagcaaatgcgcaacggcactgcttcctctcaggtgatttcccattttctgaaactcggctccaccagagcccagatcgaaaaagaattgcttgagaagcagagggatcttgccgcggcaaaggccgaagcgatcgagtcctccgccaagatggaagatctgtaccttaaggcggccaaggctatgaagagctatcaggggcaggaggatgaagaggatgaatattaaaagctattcagaacttgttcttcttccaacctttgaagatcgctttgagtatcttcggcttgatggcatcgtcggcgaaacaacttttggcttcgaccgttatatgaaccaggtcttttacaggtcgctggaatggaagaagatccgagacacggtgatcgcaagagatcttggctgcgacctcggcatcgaaggtcacgagatatttggtcgagtcatcattcaccatctgaacccgattcggcagagagatcttctggaacggacagacattctgctcgaccctgagtatctcatcacaacgacccatgagacgcatcaggcaattcactacggtgacaaaaatctgttgctcaccgaaccaccgcagcgggcaaggaacgatacttgcccctggaaacattaaaccaaaggaggaaccgactatgcagaataatcctcgtaagcaggacatcattcaggagcttcgcggtaagcgtcaggatgtgacggaactctgcactgaggcagaagcggtcgatgagccgcacactggctccggtattgttacggattgtctctatctgaatgtacgtaagctgcccgacatcaacgcagatgttgcggtcgtcattgacgtgctggcacaggtctgcgttgacttggatgcgtccacggaagacttttacaaagttcgcacttctgatggggtcgagggcttttgtatgagaaagtacattgccctttccaagtaaggagtgcatctatggatacgactgaaagcatcctgacatcagtgaagaagcttctcggaattgacgagagttacactcactttgacgccgacctcatcatgcacatcaactccgtcttttccattcttgggcagatgggagttggcccaaagaaaggttttgccatttcaggggctgatgaaaagtggtctgactttctggaggatgaccccggtcggcttgcccttgtaaaatcttatatgcaccttaaagttcggctgcttttcgacctgcctaccgcttcctctgctgttgacgcgatgaaccgtcagatcagcgagtttgagtggcggcttttcgtggcggccgataatgctgcaagagagggggaaagtcaaaatggatgaactttgccactatggcatcaaaggccagaaatggggtgttcgccgttttcagaattcggacggcagttacacctctgagggaaaacgccgcgctcagcaggagaagaaagatcctgtgaaagagatgaaagatgaagaccttagaaaggcaatcaatcggttatctctggaaaacaaatataaggatctgactaaaaagccgaccccgccctccaagcttgagtcgaccaagaaagctgtggatgccacttctgaacttgtcaatcgggcgaagaagatggatcaggacagccgcaaggctacgaagaaagagcggatggacctgagcaagaagacagacaaggagcttcgcgaccagatcaaccgcgagcttttggaacggcagtacaacgatctgtttgccaaggagtcggtgtccaaaggccgccgctatctttccgatgtgcttgacaacgccggaacggttttggctgtcggcagctcggctctgagcattgctctcgcaattcagcagttgcagaagaaggcggggtaatacttgatggccctgtcgaatactgctgttccccggtattacggaaagtttcgtgaagcagtgattcggggtgagatccctgtctgcaaagagatttcgatggagatgaaccggatcgacgatctgatcgcaaatccaggaatctattacgatgataaagctgttgagggctggatcaagtattgcgaggcagagatgaccttgacggatggttccgatcttcacctccttgacagcttcaagctgtggggcgagcaggtattcggctggtattactttgtggagcgcacggtctatgagccgaacgctgacggacgaggtgggcactatgtcaagaagatgatcaagaagcggcttgtgaacaagcaatacctgatcgtcggacgaggcgccgctaagtcgatctatgattcgtgcatccaatcattctttgagaatgtagacacaagtacgacccatcagatcacgacagctccgaccatgaagcttgccgaagaggtcatgtcaccgatccgcactgccatcacaagagcccgcggccccgtattccaatttctgacacaaggctcgctccagaacacgactggttcacaggccaaccgcgtcaagttggcctcgaccaagaaaggcattgagaactttctgaccggctctctcattgagatccgccccatgtcgatcaacaagctgcaaggtcttcgatgcaagatcgcaaccgtagacgagtggctctccggcgacattcgcgaggatgttatcggcgctattgagcagggcgcttccaaggtggacgactatctgatcgtggccaccagttcggagggtactgttcgtaacggcgccggcgataccatcaaaatggagcttatgagcattctcaaagggattatccaaacccgcatgtttcgatctggtggtacaagctcgactctgtcgacgaggtcggctatccggagatgtggatgaaggcaaacccgaacatcggaaagacggtaagttacgagacttatcagcttgatgtggaacgcgccgagaaagcgcctgccgcaaggaatgatattcttgccaagcgtttcggattgccgatggagggttatacctattacttcacctacgaagagacactgccgcatcgcaaacgcgattactggcagatggcttgcgcgcttggcggagacctttctcagggtgacgacttctgttcgttcacctttttgttcccgctacgtaacggttcctttggtgtgaagaccagaaactacattacttccagaacacttaataagctgcccgctgctatgcgtaataagtatgagcagtttatggatgagggcagtcttgtcgttttggatggaacggttctggaccctatgcaggtctatgaggacttggacgagtacatcgttgcgtgtgggtatgatgtccgctgctttggctatgacccatacaacgccaaggaatttgtggaacgctgggcggctgagaacggcccgttcggaattgagaaagtcattcagggcgcaaagacggagtccgttccattgggtgagctgaagaagctggccgaagaccggatgctcctctttgacgaagagctgatgacctatgccatgggtaactgcatcgccatggaagataccaacggaaaccggaagctgatgaagaagcggtacgagcagaaaatcgacgctgtgtcggctatgatggatgcctatatcgcttacaagcggaatccggaagcatttgaataagaaacgaggtggaacatggatttttacaacaagccatctccggccttgtttctgatgcattacggtgtaaaaggaatgaagtggggtgtcaggcgcacaccagaagagttgggtcataagccgaagcaaatggttgaaaaaaccacagaacccggtataataaagacaactgtttatgggcatagcgccaccccaaagcaagctgccccgaattctatcgcagatcatgttcgagatgacggaaaggtcgatgtacgcagtttttacgatgaagatggttggaaagcaaaagacattcatttgagcaaccacggaaatccgaagcatcattcttttggcgaacatggggagcacattgatctctatgagtggaatgaggatggcagtgtgaaacgcattgaacggcgtgaactaacagatgatgagagaaaggagaatgaagacattctatgactttgaatgaactgaaagccgctattttggagaatggaacgggcatctactttgagtttaacggaaaaaagtgtggtgttgagcctgaagttcagaattccatatttacatttaccatgtggtatggagacagctttaaggactattccgatttcgatgaattgctgcttgatggtttctttgatggcaagtcgattgtcgatcttcttgacatcatcgaaccgagtctctattgaattcaaaatggagagctaaatcatttacaatgctccgcagactttgaacggtctgcggaattttttatgccatgaaggaggtgatgagttccgaatggaaatgacagttgccacgcggctaaagcacgcatggaatacattcatgaaccgagattcttatgtttctcggatgtcgattgggccgagttacggttatcgccccgaccgtccactcttcagccgtggaaatgagcgttcgatcattacctcggtctataaccgtattgcgctggatgtctcatctatgaccgttcagcatgtgcgactggatggcagcgaccgattcaaggaggtcatcgagagtgggcttaataactgtttaacggtagaagccaatgttgaccagaccggaagggcttttatgcaggacattgttatgtcgatgctggacgagggctgcgttgctatcatccctgtcgatacaaactttgatcctgagaaaaccggcggcattgacatcgagacgatgcggaccggcaagattcttgaatggttcccgcagcatgtaaaggttcgcgtctacaatgaccagcgcggtgagaaagaggatattcttgtccccaagagtaccgtcggcattgtggagaatcctttctatgctgtcatgaatgaaccgaactctacgatgcagcggcttatccgaaagctgaacctgctggacgccattgacgagcagaacagttccggaaagctgaacctcatcattcagttgccgtatgtcatcaagacagaagcacgtcgtcaacaggcggaattgcgccgacaagatatcgagaaccagttagccagctccaaatacggtgttgcatacactgacggaactgagcatgtggtccaactgaatcgccccgtcgagaacaacctgatgtcccagatcgaatacctaacgagtatgctttacagccagttaggtttgacccagggcattctggatggctctgccgacgataagacgatgcagaactacctgactcgaatcgttgagccaatcctctctgccattgttgatgagatcaagaggaaattcctcacaaaaactgctcggtcgcaaaagcagtccatcctgttcttccgagatcccttcaagctggtgcctgtcgataagatcgctgagatgactgacaagttcacccgcaatgaggttatgacctcgaatgagatccggcagaagatcggcatgaagccttcttccgacccaaaggcggacgagctgcgcaacagcaatctgagcgcaccggcggaaagcacgccggcatcaacaccgaaggaggacaacaatcaaaatggagaagaaacttaagtacgacttcagcggctgggcgacgcgcaatgaccttgtgtgcagtgatggccgcaccattcgccgtgatgcgtttgcgcattgcgacggaaagaccgtccccctcgtatggaatcaccagcatgacgacccgaccaatattctgggccatgcgctgctggaaaaccgcgaggatggcgtttacgcttactgcacattcaacgaaactgctgccggtaaggctgctaagctgatcgtgcagcatggagatgtggattccctgtccatctatgccaacggcctgaagcagcagggcggaaatgtgatgcatggtgacatcaaggagctgagccttgtggtcgccggcgcaaatcccggagcattcatcgactttgtcgatcttgctcatggagagggcgctgagcaggaagttatcttctgtgccaacgaacctatcacgctcgcccatgcagatgaaggcaaagctgatgactctgccgatgacggcaagaagtccgccgatggcgacaagaaagacaccggagatggcgataccgttgaagatgttatcaacagcctgaccgaaaagcagaagaccgttgtggttgctctactcgccaatgctatggcccatagcgattctgacaacgatgatggcgaagagaagaaggacgacggccacatcgaacattctgacaaatccgaaggaggagataagactatgaaacacaatgttttcgagaagcctgaggacaatcaggcgaccaccctgagccattccgctcagaccgagatcatcgccagcgccaagctcaagagcgtaggcactcttcagggggctatgaagctctacgccgagcagcataacgatactctgaagcacggtatcgacgacatcgaggccctgttccccgagtataaggatctgcgcaccggcgctcctgagctcatcacccgtgaccagggctgggtcaatgtggtcatgaacaaggtccacaagagccctatcagccgtatccgtacccgcaacatggatgcccgcggcgatgatatccgcgcgcatgggtaccagaagggcaagaagaaggttccttccggcaacatgaagctgatgaagcgcaccaccgatccgcagaccatctacatcactgactccatgcaccgcgatgacatcatcgatatcaccgatttcgatgtggtcgagtaccagtacggtgtgatgcgtcagactctgctggaagaggtcgctactgctatcctgatcggtgatggtcgcgatgaggcggatgagcacaagatctctgaggagcatgtccgttctatctggaatgacgacgatctctacaccattcactatgatgtggacatcgaggctgcccgcaacgagcttcagggtaccggcaccgcttcccgtttcggcgagaactacatctacgccgaggcgatcatcacggctgccctttactcccgcgagaagttcaagggcaccggcactcccgacttcttctgcacgccgcatctggtgaatgtgatgctgctggcccgcgacaccaacggtcgccgcatctacaactccaaggctgatctggctgccgcgctgaacatcaatgagctgcacactgctgagcagttcgagggtctggcccgcaccgacaagaccggcaagaagcataacctgctgggtatcttcgtcaacctgagcgactataccgtcggctctaccaagggcggcgagatcacccgcttcaaccagttcgacatcgacttcaaccaggagaagtacctgatcgagactcgtctgtccggcgcgctgaccagactgtggtctgctatcgcactggaagagcccgtgaaggcctcttccggccagaccgaggatgccggtcacgacggcatctaagggagaaaattcaaaatggcaaaattttacggaccggtaggctatgctgaaacggtggaaacggcgcctggtgtatatgtggaaaagatcacggagcggatgtacttcggaaacttgacccgtaacaccaggcgtcttcagtcatcggaaacgctcaatgacgacatcaatgttgcgaatgagatcagcatagtcgccgatccgtttgccaaccagaatttccaccgaatgcggtatgttggctttatgggggcaaattggaaaatctccaatgttgaagtccattatccaagattgatcctgacgatcggaggtgtctacaatggagagactgcttcttcagaagacgctatctgacattcttggatgccccgaccgaggcgaaaagtgccgtgtgtactttcagcctcccgccagcaaggaaatgatttatgactgcatcgtttacgagcgcagccgtattgaacctacttttgctgataatcagccctatgcgcttcacgaccggtatcaggtaactgtgatttacagaaatcctgacagcgagatcccaagcaagatcgcgcttcttccgatgtgcagccatgaacgccactataccaaagaaaacctgaaccatgatgtgttcaacctatatttctaaccttacaaggaggaaacagctatgaagatcaaatgggatgaagccggcaagcgtctgtatgagaccggcgtcgaccacggcgtcctgttcccgatgggcgaggacaatgcatacggcaaaggcgtgccctggtacggcctgagcgccgttaacgagagcccctccggcggcgagcctaatgccgtatgggcggacaacatcaagtacctgaacctgatgagtgccgaggacttcggcgccaccatcgaggcttacacctatcccgatgagttcgaggcctgcaacggctgcgctgagatcgccccgggcgtcaccatctcccagcaggatcgaaagatgttcggcttctgctatcgcacgctgatcggcaacgatacggttggtacgaaatatggctacaagctccatctggtgtacggtgcgcaggcttctccctctgagaagaacaaccagaccgtgaacgacagccccgaggctgccaccatgagctgggagatcagcaccacgcctgtggatgttcccaatttcaagccgaccgcgcatctggtcatcgactccaccaagaccgacaaggccaagcttgcgaagctggaggagatgctgtacggcaccgatggcgaccaggccaccgaacccatgcttccgatgcccgagaaggtcatcgagctgacgaaggctgccggctgattcacggtacaagaacttctaaagcggggctctcttcactgagggctccgctttctttaatttttgaaaggagaaagcatcatgcttaagaaaaccatcgcttataccgactacaacggtaccactcgcaaggaggatttttacttcaacctgacacaggctgaggtgactgaactggaggtctctgttgagggaggcctggtcgaaatgatcaaccgcatcgttgccgcgcagaatggcaaggtcatcatcgagactttcaaggacatcattctgcgcgcttacggtgagaagtctccggatggccgtcgattcattaagaaccaggaagtccgcgatgccttcgctcagaccgaggcatacagcaacctgttcatggagctggcaaccgacgctaaggctgcgagcgagttcgtcaacggcattgttcctcccaagacggaaaaggcagccccggccgatcagagtgccgaagctcccgctgttcctgaaaactgatgataatgaggaccggcgatgctgaagatcacagtgccggctaccgaattgtttgacggggtcggaaactttatcaacaccaaggagcagacgctccagttggagcattcgctggtctctctttcaaaatgggaagccaaatggcacaagccttacttgtcccgcaaggcgatgaccatagaagagacgatcgactacatccggtgcatgacactgacacagaatgtcgacccgaatgtgtataaagcgatcactccatcaaatttgaagacggtcacggagtacattgacgctccgatgaccgccacgaccatctccaatgcaaagaaaaagggtggaagccgtaaaatcgtcacggcagaggtcatttattattggatgatctcctacggtatcccgtttgagtgccagaaatggcatctgaaccgacttctgacccttatcaatgtgtgtaatgtggaggggtcgccgcctcagaagctttcgagagcggaggttgccgcgcagtataaagcgcttaacgctgcccgacggaagcagtggaatacaagggggtaataccatgacagaaaaagaactgagagccaaagtagtctcgattgcagagaagtatctcggatgcaaggaaagcaatggctcgcatagaaaaatcatcgacctctataacagtcacaaaccgcttgcacgaggctaccccgtgaaatacacagacgcctggtgcgcaacttttgtgagcgctgtgtttattgaggccggcttgacagagatcgcgccgaccgaatgcggatgcggagcaatgatcaatctttataagaagatcggtcgttgggaagagaatgatgcctatgtcccctctccgggtgatgttgttatgtatgactggcaagataacggcgttggtgataataccggtgccgctgatcatgttggcattgtggtgagtgtttccggaaattccatcaaggtcatcgaaggaaatatgagtgatgccgttgggtatagaaccttgcgggtgaatggcaaatacattcgaggctattgcctccccaagtattctgccaaagctggttcgacaggttccaacacggcaacaccgccgagtaatggctcggcaagcaagcccgcaagtgctaaaaaggcatctgaggcagcaaggtctttcaataagactttggccggtacttatgttgtcacggcgaatgttgggctgcatatccgtaatggtgcaggaaccggtaaggccagtctcgccgtacttcccaaaggtacaaaagttgcaaactacgggtactacacacttgtcggcaatgtaaagtggctttatgttcaggtcacttacaagggtgtcacatacaccggattttgcagttctcagtatttgaagaagtaaacaagtgcaatttggaggaaaacatgatcacgttcagacaaaagggcgacttctccaagctgacgaggtttttggagagagccaaagaaacggtgcatctcggagacctcgatcagtatggccgagccggagtggccgctcttgcgtctgcaacgcctgttgactctggagaaacggcccaatcgtggtattacgagatcacgaacaagaagggttttgtgagcatctcgtttcacaattcaaatattcaaaatggagttccaatcgccatcattttgcagtatggacatggaactggaaccggcggctgggtagcgggacgtgattacatcaatcctgctatccggcctatttttgatcaaatcgcaaatgacgcatggaaggaggtcacgaagacatgagcacaacgatcgacgagagagttgttgaaatgcgattcgacaaccgtcaattcgaggcgggtgtgaagacaagtttgtccacgctcgacaaactcaaagagggtttggatctggacggtgcggctaaaggtctgaagggccttggcgacgcggctaaaaagtgcgacctttcgacccttagcaattccgtcgagactgttcggatgaaattctcggcgctcgaagtcatggcggtgaccgccctttcaaacattaccaactcggtcatcaataccggaaaacggatgatcgaatcgtttacattggagcctcccaaacaaggctttgatgaatacgagctcaagatgggctctattcagacgatcatgatgagcaccggcgcatcgttagaggaggtcaacaagtatcttcaggagctgaacacctactccgataagacaatttactctttccaggatatgacctccaatatcggtaagttcacgaatgccggcgtcggccttgaggatgctgttatggctatccagggcgtgtcgaatgtggctgccgtatctggtgcaaatgcaaacgaggcttcccgtgcaatgtataactttgcgcaggccctgtccgcaggatatgtcaagctgatcgactggaaatccattgaaaacgcgaacatggcaactgtggaattcaagacgcagcttttggagtcggctgttgcgtgcggaactttgacgaaaaccgcagacggaatgtataagaccgtcaagggaaatgtcatcgacgccacacataactttaacgattctttgcaggatcagtggatgacgacggaagctcttgtcggcacacttcgtaattatgctgatgaaacgaccgatatcggcaagaaggcattcgctgctgcacaggatgttaagacattctcacagttgatagacaccctaaaggaagctgcgggctctggctgggcgaatacctgggaaatcctctttggtgactttgaggaaaccaaggaattgtggactggtcttagtcaggcgatcggcggatttattgatacgcagtctgatgctcgtaattcggtacttcagggatggaaagaccttggcggcagaaccgagctgatcgagtctctcaagaacacgctcaaggggatcgggacagttatcaagccgatcacagaagcctttcgtgatatttttccgccaactactgcggaacagcttcataatctgacggaaggactgctgaagttcacagaaaagctgatgcttagtgacactgcttccgaaaacctgaagaacaccttcaagggtctgttcgccattcttgatatttgcaagcgggcaatcggtgcaattctgggtccggtcggttctcttcttgggaaagtaaccggcttaggcggcggtgttctcggcgtgaccggctctatcggagaatggctcgtcaagcttgacgaagcgatcaagaagaacgacgcctttggcaaaggcattgaggaaatctctgattttgtgagcggtgccgttacggccatcaagaattttgccgagtctgttcgtgaatacctcggtctgccgacgcttgacgaagcgaaggagtctatgaaagaactctttggtactgccgaagagaatattcaggttcctggactggaactcctgcacacgatcctggagaagctgaaagagcgtgccggtcaggtcaaagacgctattgtcggtctgaaagatggcatctccgatgcgttttctaagattggcggaaataccgatgtgtcgaaatttgccgcattgatccaagcactatccattgccgctaagaaaattggcgggggtattttcgatgcgctcggcaacggcatcaataagatcgtaactgcggtgagtaacgctgattttagcggaatcatcgacctgctgaacggaatttctatcggcggtattgcgattgccataaccaaattcactaatagtttgacgaagccctttgatgaagtcggaggtcttcttgacaatgtgaaggggattctggatggggttcgtggatgctttgaggcgtatcagacgcagttaaaagccggaactttgctgaaaatagcaagtgctattgcaattctggcggcatctatcgtcgcgatttctcttattgatagtgagaagttatctgcgtcactgggagctattacggttctctttgccgaattgatggcatccatgtcggtctttaccaaaatcagcggagatgttaaaggcgcggtgaagagttcgacagtgatgctcgccatgtccacatccatcctgatccttgcatcagctctgaaaaagatcggtgacttggatggtggacagcttgcaaaaggtgttgccggtgtgacagccttgatggcggcgatggtcggtgcggtgaagctgcttaacatgagcggcggttcttcgatgaagggtgcgacacagatggttctctttgcggcttccatcaagatccttgcatcggtctgtacagaccttgcaacacttgaatggaatgggcttgtaaaagggctgactggtgtcggtgtactgctggcagaagtctcactctttatgaacaccgcaaagttcagtggaaagtctttgacaacagcggcgggaatcgtcatccttgcctcggcaatcaaaatcctggcatctgcctgtaaggatctcggtagtctcgatttcggacagcttgtgaaggggcttggctccattggtgttcttctggcggagatcacggtctttaccaagttgaccggtaatgcaaagggtctggtatccaccgggatcgcgatgatcgggattggcgctgctatgaaaatctttgcttccgcgatgggcgacttcggaaaccttgactggaatcagatcgccaaggggcttgtcgctatgggcggcgcattggccgaagtggctatcgctatgaaggtgatgcctaagaacacgataagtgttggcattggtctgatcgctgtcggtgcagcacttgagatcgtggcaaatgcccttggaaagatgggcggtatgacctgggaagagattgcaaaagggctcgtcacaatgggcggcgctcttgcagagcttgccatcggtctgaatgtgatgaacggtactttgcctggctctgctgccatgctggtagcggctggcgcattggctattctgactccggtgctgctggctcttggctcaatgagttgggagagcatcgccaaggggcttgtgacgattgccggtgcattcaccgtgatcggtgtggccggtcttgtgctgactcctcttgttccgacgatcctggcactttccggagcatttgcgttgatcggtgtcggtaccgcagccatcggagcaggtcttctcgctgccggtgccggactgtcggctattgcagtcggcattaccgccttggctacttctcttggcgcaggtgtgaccgttattgtggcaggactcagcacgatcatcacagggattgccgcgttgatccctgccgttgccgaaaagctcggtgaggctattatagcgttctgcggcgtgatcactcagggagctcccgctattggagaagctgttaaggccgtcgttcttacgctggttgatgtacttgttgagtgcgtccctgcaatcgctgacggtgcattagcactgctgtccggcgtgctcgcctctcttgcaaactatactccggaaatcgttgactctattatgctgttcctgatcaacctgctgaacggcattgcagagcggctgcccgaactcattcaggcggcagtcaatgtgatcgcggcattcttctccggcatcattgatgctctggcaggacttgatacaagtgtattggtgaaaaccatcgccggcatcggtctgctgtccggcattatggtcgcattgggtgcggtagccgcattgatcccaagcgctatgataggtgtgctcggcattggtgctcttatcgctgagctggcgatcgttcttgctgctgttggtacccttgcacagatccccggcctttcctggctgatcggtgagggcggtaagctgctggagcagatcggtacggcgatcggtgggtttgtcggcggcattgtcggtggattcatgagtggtatttccagtcagttcccgcagatcggcagtgatcttgcagcgtttatgacaaatgttcagccgtttatcgacggcgcaagcagcatctctccggcgatgttcagcggtgtgcaggcattgacagacgcgatattgctgcttacgaaggccgagcttgtgcagggtattgcatcctggttcacgggtagttcttctctttctgattttgctgatgagctcgttccgttcggagaaagcatgacggagttcagcaacgcaatcagcgggatggacgccgaccttgtttccaaagcggcgactgccggtaaggcacttgcagagatggccacaacgctgccgaacagcggcggtgtagtcggcttctttgccggtgagaatgacatggacaagtttggagagcagttggttccgttcggaaaggccatgaaggattactctctcgctgtcaaaggaatggatgtcggtgccgtcagcaattccgcttctgccggtaaggcgctcgtggaactatccaataccattccgaactgcggcgggcttgtgagtttcttcaccggagacaacagtattgccgacttcggcgaccagctcgttcttttcggcaatggtcttgcggcttactccgcctctatcgagggtatcaacatgagcaagctctccagcgcgatcacacaggtcgagaagctggtggcgctttccgatatggtgaagaatatggatcagtatgcatttgtgaactttacgaatgcgctgattctgctggcaaacacaagtatccaaaactttaccgacgccttctataacagtggagctaccgtgagcacggcaatcatctatatgctcaattccgcaggcacgaccatccggcagaaccagacgatcgttaatgtggcgatggctgagctgatgcttgcgatggccgcgactgtgaaagcacataccacgagcatgaataccgcggtcgtgcagatgatggtcggcttcagcaccacgatccgcagcaacggtgcttccgtgcggacggcgatgcagtctgtcatgctggtcgttgtggcagaagtgaacaactacaaggaccagttcaatgaagccggcaggaatgtttcgcagggctttatcaacggcatccgctcgaagctgagcggcgcctctcaggcgggccgtgatctgggccttgcggcgctgaatgcggcaaagaaggcgttggacagccattctccctcccgtgagtttatcgagcttggtaaaaacattggcgagggtatgaccatcggtatcaacaacgcgatcgttccggtttcttcggctgcggcaaagatgagcgatgaagccatcaaggtcgcgcagaagggactcgactcctttaaggattgggcggaagagcggaaatattacagcgagctcagcttgaaagaggagcttgccggatgggaaacgctccagaagaaataccgcgagggcagtgaggaacgaaagcagatcgaccgcgaggtctatcgtgttcaaaatgagttggttacggccacttatcagtattcgatgaactggatcgaagagcagaaatcgtataacaagctgacccttgcggaggaactggctgcctataagcgtgttcagagccgatatgccaaggggacagagctgcggaagaagctcgacctgcaagtttaccagttggagaaagagatcagcgacgcgcagaaacagtatatctctgatgtgcagtctgtgcagagcgaggcgaaccagaagcggctcgacctggaggaagagtacgccgataaggtaaagtcgatcaacgcgcaactggcgagcgatattcaggctgagaacgacaagtacgagaatgctctgaaatcccgcgaggattccctctataagtcctatggcctctttgacgctgtgaaggagcgtgatgaggtcagcggcgacaccctgatgaagaatcttgagggtcaggtcaaggaatttggcgaatggcaggatattttagagtctcttgccggcagaggacttgacagtgaccttatcgaggaacttcaggatatgggtcctgacgcgatcgcccagatcaaggcgctgaacaacatgagcgactccgagcttgagaagtatgctgacctctggaaggtcaagcacgcaatggctcgcgagcaggcggtcggcgaattagaggggctgcgtgaagagacccagcagaatattgcaaaactccgcgaggaggccgatcaggagctcaccgagtatcgtgctctctggcaggagaagatgaaccaggttacggaagatgccaacgctcagttggaacagctccgcagaagctttgaggaaaaggttggtcttatcaagaacaatactgaggatgagcttcaggagatggccgacacggcgcagaaggttctgacggaagctggctgggatgagaccggcaagcagatcgtcaaggggcttactgaaggcattcagtctgagaagtccagctttgttgatgagatcacgcaactggctcttgcaggcgtacaggcggcgaaatcgacactggacatccactctccatcgagggtattccgtgagatcggtaactacaccggccttggtttcgtgaaaggtcttcaggactatgttgaccgatcttatgcggccggttctgagatggcggagtcggccgagggcggtctttccggtgtgctccagaccattgccgacattgtgagcggcgggttcgacatggagccagtgatccgtcctgttctggatctctccgccgtatcggctggagcagacgccttgaacaacctattctattcgcagcgagcggtcggccttgtcgggcaggctgccgttgcatttgaggcacagcgcggcggaagcagccagacaaccatttccgtcgacaatgatgatgttgtggctgaactccgtacgcttcgaggtgagatggcttcgatgctggaacgcatggagaagctgcgtgttgtgctgaacaccggtgcgctcgtcggcgaacttgctgaaccgatggatgtggcgctcgggcagcggtctacacaaagaggaagggggatttaagttgtaccattcgatcacatttggcgataagaacacatgggacgattggcggcttgcccccgcttcccgtccgctattcaatccacctgcgcaaaaggtaaagactctggacattcccggtggggacggcgtcattgatctgtcgcaagccctcaccgggtatccggtgtatcagaaccggacagggtctatcgagtttattgtcatgaatgatttcaaaccatggcacatggcgtactcggacatcatggactatctgcatggacagaccatgcgggcgatccttgaggacgatcctgaatatttctacgaaggtcgcttcacagtgaacgcctggaagtcggaaaaggactggtcgcggctcgtcatcgactacgatgtcggcccgtacaagtggaaaaacctttcctccatcgacaactggctatgggacccgttcaactttcaaaatggagtcattcaggcagctttgttccgcaatattgcggtgacgacagagatgaaagagatcgagctggacgcggtgatgtacggacgggctccggtatgccccagattcattgtgcaaagtagtgaagggcgcggcgttcatgtccgatttgtcaaccgtcagctcagcatcgacctaacaaagcttttgccggatggaaccattcagatccctgagtttattctgtttggcgactatggcggaacgatctatctttgggtcgacgagggaacggggaccgtgtccgttgatttcagacaagggaggttgtaagcgatgtattctgtttatgccgatggcgtctgcatctacaatgatgccttcgcgttggacaacatgaagcttgcaagccccaagctgacgctggaagacaatgcggccggttccttcgtgatgacggttccgccctccaatctcggatacagcaccatcatccgtatggtgactgacatcgccgtccacaaggacggaaaagagatctgggcggggcgcgtcctctctgaaaacgaggacttttacagaaaccgggtgcttacttgcgagggcgagcttgcattcttcaacgacagcacacagccgcctgcggagtacgccggagggacgattcgtgagtaccttgaggcgatgatcgccattcacaacgcaaaggtcggagacaaccggaagttcaccatcggcattgttactgtggtggatgaagattttccgacttattacaccaactatgaaaagaccatcacgatcttgaatgcgttggtggcgcagtacggcggtcatctgcgggtgcgtaaggaagacggcatccgctatctcgactatttggctgattaccccgacacttgcagccagacgatccagttcggctccaacctcatcgaacacaccaagggatgggatatgacggagttcgcaacggtcatcgttccgcttggcaacaggcttgacaagagcgagatcgaggcattggacgcctatctgactgtggagagtgtgaatgagggcagcctttatgtccagtcctccgaggctgtgaaaacctatggctggatcgagaaaacagtgacatgggacagcgtttctgatcctgaagcgctgctggaaaaggcgaaggcatatcttgccgacttacagttcgacaatatggaactggaagtgagtgcccttgacctccattatcttaatgcgaatgtggaggcagtgaaactgctggacgagatccgcgtgatctcgcgaccgcatggtcttgaccgtgtatttcctgtcacgaagctggagatccctctggacagcccggagaatacccagtttacgctcggcgacacggtgcagacaagccttaccagtgtgaacaaccagatcagcgccgctatccttgagaaaatcgagggtctccccaaggcgcacaacatcctgaaagaggcaaaagaaaacgccacacagatcatgacagcggccacgaccggctacatcacgatcacacgggacgaatacggttctgacacgctttatatttccaatatccgcgactataccaaagccgacaagctctggaaatggaacatgaacggccttggctactcaaaggattacggaaagacctttgggcttgccattacaatggatggttctattgtggcagactatatcacgaccggtgttctcaatgctgatgtaatccgtgccggtacgctgaaagattatggcggaaacttctcgcttgacttcgagagcggcaagctgacgatgaagaaaggctccatcgacattggagacggaaacttcactgttgacgaggaaggcaaccttaccgcacgccgaggcacctttgcgggtactctggctgcggcgaaaggcaccttcagcggtacgctggtcggtgtggacggaaacttcaagggcgtggttcaggcctctgacttccttgaccgagcgggcaacagcatgatggatgacgagcgattcaagtccaaatatctgagcgtctacgggcttaccgttaccaacggtgtccgcacgacctttgctgttgattccagcggttccgttaccatagatggtaaggtgacgctgtccgccggaagcacgatcaactgggcgtccgtgacgaaccagaatctcacctccaacccagcctactcgctggcaagcacggcgaatgcaaacgcggccactgcaaagagcgcagcagatgatgcttacgatgaggcttctgctgcatggtcgagagcaaataaggcctatcaggatcggtgcaccgaccagaatgtgtttgatgtgctcacctcaggtggtacgaagttcggtattttcagcgactcgtacagcggacggctttacatcaatgccgattatattcgctccggcacaatcaatgccgattatatcgacctatcatgcgattatggtggattctgcaaagggcatggctctgacggtcagcatacgacttatggcgcgatgatgtatggttctaacggtcctggttgggagccttatattatcgttaccaatgccggcgcccgtatctccggaaccggagcagaccttgtagtttccggcggcatcaccatgagtgaagagccaagttacggttccgacttaaggatcaagaacagcatcgactatgatcttgcctcttatgaggcgttcttcctggcgctgaagccatccaccttcaagtacaacaaaggtacttccgggcggaaacatttcggcttcatcgcgcaggatgtagaacaggcaatgcttgacaccggactgacgtcggatcaacttgcggcacttgtcaaagatcctgtcaaagagatcctttcggatggcatcatagactatcgttacagcatccgatacggtgaacttatcgcgctcaatacgcacatgatccagaaactctatcaaatggtcgaagaactgcttcagcaaaaggagggataatgttgaagaaacagcttaaaaattcagaaatggtcgtgatggtccagaacctgcggccgcttcttcagctccgcaacaagatcggctatatcgccgcgaggaacttccggatgctttctactgctctgaccgagtatgaagcattcaaacacgacctcatcaacaaatacggagagcccgacaaggatgaaagtggcaacgagaccggaaccatttccatcaaggttggctctcctaattttaaggccttctgcgacgagcttgccccgttcaacgagatggagcatgaggtcgagctgatgaccgccaagtatgaagatacgatcggttgtcttagcggcgaggagattctgctgctcgactggatgctggaggactaaggaaggagtgatttagatggctgatatcagcagctttctgaaaaaaatcctcagcgccatttatggcgaagaggttcgcggctccatccatgatgctctggcggcgatgaacacggagtccagcagcgcgatggagtttgcctccaccgccaaggattctgcacaggcaaatgccgcggctgccaagaagtccgccgaagatgccgagaaaaaggcgacaagcgcctctgaatccgctgcggcggctgcactctccgaggggagcatcaagacctctgaggaaaatgtcaacaagcaggccgcagacgcaaaagaagctgccgccggtgctaaggcgtctgagacagaggcgaagaactcggaagagatcgccaagcagaaggcacaggaggccacggacgccaagacagcggcgatgcttgccgagggagaggtcaaggctgccgaggagcgcgtgagaaccatccgctcggaggctgagacgcttggcgcacaggctactgctgaccgcaacgcagcggaagaggctcgtgctgctgcggaagctgcaagagacgcggcggtgaagagtcaaaatggagcaaaagcatcggaagatgccgctgctgtatcgaagacggacgccgaagccgctaaaacggctgctgtggatgcccgtgacaaggcgcagaccgctaaaacggccgccgagaacgcgcgggagtccgccgagaactctgaggcaaacgccaagacttacaaggagtctgccgcagagagcgccgcaaccgcacagcagtacagcggaaagccgcctaagccggagaacggtacctggtggatctgggacgctgaaaagggcacctatgtaaacaccaacatcagctgcgagctgaccggcccgaccggcaacggtatccagagcattcagttgacgcagggcaatcatacgccaggctcgactgatatttacaccgttacgatgacagacggaagcaagtacaacatcgccgtctacaacggcctgaacggaacgggtacgggcgatgtgctcggcatccatttcgatctggtgctgcctgcctccggatggtcgaacggttccatcactgtggcggagagccgccttgtggccgctgccaagtacaaatacctcattgatgcatatgaagccagccgtgaagaatacctcgaatgcagtgtgcgtccgaaagacatctccactaccggcttcattacatttgtgaacgataccgacccgatcaaagacatcacggtgaacatcgtgcgtcttgaactgtcggtcaatgccgaagaaggaggcgaatgatttgaaaatcgcgatcaaaagctgcttcaccacgctggtggaggacactacactgatccagaacgcagcgacgccttatccggtcgaattcgccttcagcaaggattgggacgggttcgcaaagactgcgctctttgaggcaggcggcgtcagcatggctgtggtgcttagcgaagacaagtgcgacattccgggcgaatgcctgaagaaaggcggtatcccgctgaagatcgccgtttatggcgtcaagggcgaggaacgaaagtcgactggctggcatgtgaccagcaagatcctcttcccggccaatatcagcgttggcacaggcggctccggagacccgatgggcgatgaagcctacaagcagatcatgggaatcatcggagacccatcaacggcgggttttggaaacaagacgctgaccgaggtgatcgttgagatccagagaagcatttccggaacggcctcggataaagaggtcgacgatatgctgaacgacgcctttgcttcgagcgacccgggcggaagcacacccgacaacaccgcttctgacaaagaagtggatgacctactcaatgatgttttcggcgaacagccgtgaacaaatatatttaagggggacatgcaatatgtctactaccaagcacactactattgaacagctcaagaaactggcgctgcgcacaaagagcgagattggccttgtcgacgctaaggttgccggcctgaccactaaggtcaatgacctggtgactgccggcggcgagcctaacaagctggaaggcatcaagctcaacggcactctgctggccctgaccgataagatcgccgacattctcatcgctgagggcaagaccaacggcaccatctccgccaacggcgttgatattcccgttcacggtctggcggctctggcctacaagtccgaggttgctgagagcgatctggctgccgctctgaaggccatcatcgacgccaaggcgaagcaggctgacctggataccctgaccggcgacggcgaaggctccatcagcaagatgatcgacaaggctatcaacaagttcgccaccgatgtgaccgatgacaatgtggtcaacagctacaaagagctgatcgactgggttgctaagcacggacctgaggcgaccaagatggccggcggcatcagcgagaacaagaccgctatcgccgacctgaagactcttgtcggcacgctgcccgatggtgcgacctctaccaccgttgtcgcctacatcaccgaggcgatcaatgctctgagcatcggcgattacgccaagacgaccgaggtgactgccgcgatcaacaccgccctggagtcttactacaccaagacccaggtcgacgaaacctttgtcaagaagacggacatcgtgatggctaccgacgaggaagtcgacgccatgctgaccgaagtcttcggcgctcaggctaccgtctgatccagcatatgcgaacgggggatggggcttcctgtcccccgttccaccttttgaaaggaaggtaacaacacatggcagagcataagctttccacatttgaccagctcaaaaagctggcacttgcggggaagagggattccgccaagcaggtagctgaattggcggagcttgttgccgccggactggaggatctccagcatatcggcatctctgttactctgccggccgcgaattggagcggcggagcgcagactgttgcacatgcttccctcttagctgacagcaactatatttatcttgtaggcgcagacgccggtacccgtaatgtgtacgacagttatggcgtgagcgcagacaatgtaaccacaagcgggcagatgactttccggtgcgatacaacgccgaccgttgacttgtccgtctttatcattcgactggaggtcggaacagatgagtaatgttggcaaggtattcaacctttccggcggcggtggcagcggctctccgaagatggaaagtctgactatcgccaccccgcccaacaagacggtctataagtccggtgaaactttcgaccccaccggcatggtcgttgtggcaaactacggcgaaggtctgatggcaaatgtgacgggttacaccgtctctccctccgttcttacggacggggtgagcgaagttgtcatcacctacaccgagggtcgcatcacgaagaccgcgactgtttctgtgacggtgaaaaaggtgcttgtcagcatcgccatcaccacgcagccagccaagacggtctaccagtatcaggagagccttgatccgacgggcatggtcgtgaccgcgaccttctcggacgggagcacggcggcggtactggattacacctatccgacgacgaacttctctacactggggcgtcaggtcatgaagcttgaatacacctacgaaggcgtgacgaagagcacagaccttgtcgttacggtgcagggcaagaccattgccgttccgacgcagacgaacatcccgacctacaacggttcggataagacgccgagctggaacggctacgatccactcaaaatggagatctccggcgttacgagcgcctctgacgcaggtggttacacggcgatcttcaagctgtcctacggctatctgttcccggacggcacggatgaggcccgcgtaaagtggacgatcgaccgcgctgtcatctcggctttgccgacgcagacgggaacgcttgttgccgacggcacgagcaagacaccgagctggaacggctatgacaccaacaagatgaccattggcggcgatacctccggtacggctgccggtgagtacacggcgacctttacaccgacttccaactacaagtggtccgacggcagcacaggcgccaaggaagtgaagtggacgatcatctcggtgctcgtttccattccttcgcagagcggtacgctgacctacaacggcagcgcccagacgccgaagtggcagaatttcgacaatgagaactcctctgtgagcgtatctgccaagacgaatgccggcgagtacatggcgacctttaccttgaagaagggtatgtggacggacggtacgaccgcggcaaagaccatcaagtggaccatcggcagagctaccatcgcggcggtccccgcccagaacggcacgcttgtctatgacggcaacccgaagactccttcgtggaataccgcctatgactcggcaaagatgaccgtttccgtgacggccgctaccaacgcaggcacttacagcgccacctttacgccgacttccaactacaagtggtccgacggcagcaccggaggcaagacagtatcgtggacgatcggcaaggccgtgaacagcgtgaccaattcgccgagctccatcatgctgaagagcagtgccaagaccgcaacctttacggtgaaccgcaagggcaacggtacgatcacagccacctcgaacaacacgagcgtcgcgaagatcaaatccatcaatcaaagcaccggcgttgtgaccgttgagagcgtgaacgacacgaccggcacggccaagatcaccgtcaaggtcgccgaggggacgaactacaaggcggcttctgatacgacggtcaatgtgacggccactttcgtcacgatctacggcgttgagtgggattggacgagcagcggccagaccaagggcacgcgcacagacgcggcggcaggcttcggtgacccgtctccggcggtgaacaacggcagtggctcttctccatttgacaacctgatgccgtggtccggcatggtgaaggagacccgcagcggcggcgttgaggtcaaggagccaaagtattggttcaagtggacgaagaccggcaagaagctgaagctccagatcgcggacggttatgtcgagggcttctccgtcgaccctgtaaacagggatcgcggggacggccttggcgagctggactactcctacatcggccgttatcactgcgccagcggttataagtccaccacgggcgccgcacagcaggtaaacatcacgagaagccaggcgagaaccggcatccataacctcggtgctaacttctggcagatggatttcgctcagttctggtatgtgaatatgttgtttctcgtggaatttgccgactggaacggcgagcgcatcggcagaggctgctctacgaacggttccaagatgaacaacggtcagaccgacgcgatgggttatcacaccggtacgaccgcggcaagccgcgacagctacggcttcacgcagtatcgcaacatcgaaggctggtgggacaatgtttatgactggatggacggctgctattacaacaataacggcctgaatgtcatcagcaatcccaacaacttcagcgacagcgcgaatggcacgctggtcggcacgccctcttcgggctatccgtccgacttcaccattccgacagcaagcggtcttgaatgggcactgttcccgagcgcggcaaacggcagtcaaacgacttatgtcccggatgactggttcttcagtggtagatatccgtgcctgtaccatggcggtagctataaccaggaccagtatcacggtccgttcttcatcatctacttcaacagcgcgtcggtcacgaacgacaacatcggctgtcgcctccaggaacgcccgccaaaggcggcgtgactgttcccctgaagaggtaggggtgcaggggtgagggggccgcagccccttccccttgcatttcactgatatttttaagaaaaacaacaatttaacatggggtcaactgtgcagcagacgatggtcccggataactggaacttcaatggtagatatccgtgcctgtaccatggcggtaactataaccagaaccagaatcacggtccgttctacatcaactacaacaacgcgtcgaacacgaacgacaacatcggctgtcgcatccttgctgagccacaggctaaccctccatttggtagtaggggttcctcaccctttctatatcgcacggttgaccgcacagcacttgctgaagaaaagccgacaggacacagcttagtacacttcgggccaggtctcgccttggaacaccccgcggcgctggaacggttgtgaggctacaaggaggaaaaacatccctgatgaaacgagttcgagtttacaaagagatcatatcagacgaaaaccttcgtctggcaattcgggaagtgaacgccggccatcggcgaaacggcaatcacagcctgaacaaaaaggtcattgagatcgaaaataatatggatgaatatgtggagaagctccgagcattcatccaaggtctggtcgacggagacgagcacatgcaccctccccttaagcgacggcgctgggaccgcaacgcggacagcggcaaaggcaaatggagagacatcaacgagccgcttctgtggccggaccaatatgttcaccacgctgttgtgcagccgatgatcccgcacattatgcggagcatggaccggtactgcatcgcaagcgtccccggccgagggaactcctacggcgtcaaggcattgaagaagtggatgaagaacgatgtggagggcacgaagtattgctgcgagtgcgacatttaccactgctttgaggagcttgatccgccgtatgtcattgaagccttgaagcgggtgttcaaggacaccgaaacgctctggctgtgcgacgccattatggaatacggagtcctcatcggcgcattcttctccgcatggtttctccatttgacactccagcccttggatctgatgatccataaaaagcagtatggcgtatcacactatctgcggcagatggacaacttcacgatcttcggctccaacaagcgaaagctgaggaggctgctggaggatatcaagaagtggcttgccgagatcggaatgaagatcaaaggtaactggcagatcttccgcgtcgggtttacgccaaaagtcgagagagcacatcaggctttgccgaagaaaaagcaacggcaccgccgcccgcgcttaccatcggctcttggataccgattcggacacggttacacgatcttgcgaaagcataatctattccggctcaagcaatcgcttcatctttactactaccggcgagacaggaaccgcgtcatctcattcaagagggcttcgggactgatctcacggctcggacagcttcgcaaatgcaatcatcagcaggttttggacaggcattatcagcccaagacgatgtttgcactgaagaaagtcgtccgaaaggagtgcagaagacttcaggcattatatccgccataccaggcggcataaaaaggagtgattttcatgaaagtacagggaatggtcaaccccggcagctttactgtggaagagatccccggtaccaaacgaagtcttgtccgtctctaccagaatgtggaggcgtgcaagatcgctaaggatgccgaggacaaggaaggccttgacgggttccagtatgacgaatactgcgttgaggtcgagagttggcccggacttgctgccagcgtgcgggagaactacgacacctaccttgcaaagggtaaggacaatgaggtcgaccgcagtaactatgcgttgttccgcgctcagaaaaacacagactccatcgtccaggatacggacgcgatgagcgtggatcacgaataccgactgaccctgcttgagctgggtctctcggaataattgagaaaggaggaaaacgactatgctgtatcgcactctgaagcgcatgatcgagcgcggccagaccaacggccttgaggaaaagatcgacattttcttcgcagccggcaagctgaccgaaagcgagtatcaggagctcatcgccatgctcaaggcagaatgaacgcaccggaggattgagatgtgactattcaagagattttagccggcgggggcggtctgctcctgatccttatgaccctggtgcaaatcgcccccgtcaaaatcaacccctggtcagcactcgccaaagccattggcaaggcgatcaatgctgacatttcaaagcgcctcgacgagattgagaaaaagctggactcacatatcaaaacggatgatcaaggccgggccgatgactggcgagcggcgatactccgatttaacaatgagctgcttcgtccgatccgtcatacgaaggaagaattcgtagaggtacttgggtatatcgacaagtacgagcattattgcgaaaagaaccctgagtatccaaacagccgagcggaaattgccattgagaacattcgagaggtgtataaggtccggctgaagaaacgagacttccttcaggacgaggataagaaggaggtggcgacgctgtgagcaggtggggcatcggcctttccgagcaaatgaaagcctgcaaagaagcggaaccgttcactgatattttggagggggatgggggtgttcctgaaaaggaccccccgtcttcttccaaagcagggttcaaggtcaccacgatgaagattatcgtgtgggtctgcattctcaacggacttgcatgggtatggtgcagctatatccttgcattgctcggacgggagcagatcgcagaggccttgtcacaggtcgcgctcaaggagatcatcggcgtggtgctgatctacggtctcaaggcgctgtttgaaaacctgagcaagaacaactcgtggcctgacaagggaaactctactccgcccgaagacggagcgggataacaggaggaaaagaatatggagagtgtactgaactggtctgtcatcatcagcatcattggcgtgctggtggtgctgacgaacattgtggtacaggtactcaagaaagtaacctgggacaagctgccgacgaatgctctggcgatgatcgtttcgctggtgctgacgctcggcgctttctttgcatattgttccatcaaggggatcgctgttgtgtggtatatggtgtttgccgcggtggtcctcgcgttcatggtggcttatgcggcaatgttcggatttgacaagctgaaagaagccctcgggcagatccataagtagtgattagaggtcgaaaaaggtgtaggagagccggttatttcttgactactcctacacctatggcctaaaagtggcgtggggactggatttgatgcttctattataaaatacgtgctaaaataaagtcaaccgccgctctgcggaattcaaaaaaggaggactgccctgtgatggacagagaattttggatgggacccagttttccccagcagccccgagaactgttgaaccgcttgaaatcctatggtgtctgcgtggtggcagatgccctgaagggctttaacgccatgaacggctctattcagccggtggtaccgggcaaatgcatatgcggttgtgcggtaaccgtgcgtctgcaccccggagacaatttgttgctccataaggccattgagtccgcccagcccggggacattctggtgctggacaccaacagcagctatcgcagggccgtcatcggcggaatcatgtccggggccgctttcggcaaaggcatcggcggcttggtggtggatggcgccgtccgggatgtggaggagctccgcgcccacggctggccggtgttcgccgccgccgtggttccctgcgccgcggacagcgatggccccggccagctgaatcaccccatcagctgcggcggtgtgccggtccatccgggagatatcatcctggcggatgacaacggcgtcgccgtcatccccccacatgggtggagtgggtgctggagggctgtgaaaagcggcatcagtccgaggcccgccgcatggcggagatccgacaggggcagctgacctccgccgctgtgctgggcaagctggaaaagctgggactgtgaggaggggcagcatgatctccaaactggaacgccttttgtccggcgggaccgtgacgtgggaccgtctcctggtgacggacggcctgtccccggaggcagtggagcagatcaccgctgtctcccccgccgcgccggaccgggtctgggtggtcattgatcacgacactcccgccggctccgtggcggtggcggaaaaacagaaagccctgctggactgggcccggcagaccggcgccgtcttccgctccggccggggcatcgggtatgccctgctgctggagtccgggctgcgggagggcgagatcgtcctctccggcggagcccatgccgcggcggtgggagccgccggcgcggtgggcctgtccctgcctccggcggagctggccggcgcgctggagagcgggcagatctccctgtccccggctccgccgctgcggctggcggtgaccggcccgctctctccctatctctccgtccgggatctggcctggaccctgatccggagcggccagtgcagcggaaaagccgtggtcatccgggcgccgcagctgaccgccgcccaggccatggacctgtgcggcctgctgggcgccgccggagctgtgaccgcgctctgtgtgcgggaggacttcccggcagatgagacggtggatctgactgcccttcagcccatggcaacgccgcccggggacgccgcgcgggtcgttcccgccggagaaaccgacggactgcgggtgaatcaggtgttcatcggcggctgcggcggcgggagcctggaggccctgcgggagacagcggacctctggcggggccggaccgtatgcccctatgtgcgggtcatggtggcgcccgccacttcctctgtctatgtccaggcactagaggaagggcttctggatgtttttctggatgccggggcgttggtgatgaaccagggctgttccgcctgctgggcccagagccaggggcggtgcgatcaggcggaggtgttcgtctccactggctccatcaactgtgccggctgggcgggcagagcccacagcggcatctgcctgaccacggtccgccgggccgcccaggcggcgctgtccggcagtctctatggttcctgagaggaggtccgccatggaacagacgttttgcagccgcatctggcggctgagcgacaatatcgatactgatatcatcatcatgagcaagtatctggccaagccctccctccgggagatggtcccccatctgttcgagcccctgcggccagagctggccgcccggctgcggcccggggatgccatcgtggccggggagaacttcggctgcggctcctcccgggagatggctgcctccgtcctcaaaaccgcgggcatccgctgcatcatcgccaagagctttgccaagatctttttccgcaatgccatcaacaacggcctgctgctgatcgagtgccgggacctgtatgaccgctgccgggaaggcgacactgtgaaggtggaggtaggccggcagatcatctgcaacggcacggcctaccctgtccccggtatgagcacggaggtactggatatcctccgttacggcggcctggtgtcccggatgcgggcgctggacaaatctctcccggccgctcccgctccacgggacacgctgcgggacgtccaccgtccaggccataccctggcggagcagctcctcatccacaacaccggcgcacaggacctacgccccggagacgtggtgacggtccgggtggacgaggcggtcctccatgatatctacaccccttatatcttccagcagttccgggacatgggattctatcatgtgtatgacccggaccggatctccgtcatggtggaccatctgtaccccacctgtctggatgatgacccccgatgcttccggtacagccgccgcttccaggacgagtatggcgtgaagcgcctctatgtggcggacggcatcagccatcagctggcgctggaggagcgtctggccgcccccggcaagatcatcttcggcacggacagccacaccaccacctacggtgccgtgggcgccttcgcctccggcgtcggctatacggagatggcctccatcatcggctgcgggcagctgtgggtccgggtcccctccgccatcaaggtggtggtgaacgggaccctgcccaaaggtgtctttcccaaggacatcatcctgcgggtactgggagacctgactgccgccggtgccatctacaagtccctggaattcacaggctctaccattcagcagctcagcatctccggccgggccgccatcgccaacatggcagtggagtgcggggccaaggcggccctgttcgccccggacgaaaagaccgccgccttctgcggcgtggacctggcggactgtgactggcttcgctttgacggggatgcccggtacgaacgggtcctgacctatgacgcaggcactttccggccttatctctcctgcccctacggggtggacaacgtacaccccatcgaggatgtagcgggcacgccggtggatcaggtgttcatcggcagctgcaccaatggccgtctggaggatctggccgcggcggcggcagtgctgaaaggacacgccatcgccccctttgtccggctgatcgtgacgccggcctccagagctgtctaccgggaggccgcccggctgggatacctgaagacgctggtggaggcaggcgccatggtgacccatccatactgctctctgtgccagggccgcagcggcggtctggtcagcggagcgcaggtggtcatcggcacccacaaccgcaacttcatcggccgtatgggcagccctgccgcccggacttttctggccagtcccgcagtggccgcggcctccgcgctggagggacgcatcgccgaccccgcgccctatttgtgacggtcccagatcaggcccgcttccggggtaccccaacacaggcccccggctgtctggtgtagccgggagcctgtgttctgtgagggtcgggtgagcgggctttatgtccaggtgtaattctccacaaagttcaggatggtcttgttgaactgctccgggtcctccaggaacatcacatgtcccagatccaagaattcgtggaagcagcaattaccattcaccaaatcccgatagtgccgccccatttcgatccccgggggatggccgggctgtccgcacagcacagcaggaggggaatgtcgatcttggagagagtctctgtataatccttgaacaaaaaatcgttatacagagcaaaggcgatatataccggcagcttcttcatttccgtactgacccagtcctcgtcctcctgacaaggcggtgtatggaagcagagccgggtaaacgtccgggcgtaatcatcgtggtgggagagcgcgttctccaaggtggcagtcatggcgtccatgttgaagcccgccaaagaatggctgttccaggactccggcgaaaaagggtacaaggcagagtcgatgacgccgatcttcttcagatgctcgtcgccgaactgctcgtagtactccatcaccacactgctgcccatagaccagcccagcagtgtcacatcctccaggcccaaatactcaatgagttcatgaacatccttggcacagcggtccatagtgagattttgaagcgtttttgacgaagaaccgtgcccccgccagtctatcagcaccagccggtgatcggcggagagggcatcaatatttttatagaaaaatttggacgagcagagaaagccatggaggatcatgatcggctcccccttgtccttgccgtagtcctcaaaatagatccaggcgccgtcgctgacctgaaggaaattgtccttgctcctgatcatacctctacttcctttcttagtctttcaatgtatcgatcttggcatacttctcatcatagtcctcacagaagaacacctggaaatatcccagcttgacccgttctttctgcgtggcatagctgacagccaccaacagcaccagagagatcagccaggcaggcaggaaagcgtggacaccccccagcgccgcagcccaccactcctttgtggatgggatcacgccggagatgaaataaagaatgacgtatgcggcaaaaccgcccaccgtagaggcgaacattccctttgctgtggctttcttccagtacatgcccaccagaacagggaagtaccaggccgctgcaagggctgccagggcgaagttgatcatgtactgggtcagggtagagggcttcagggcgatcaacgtcgccaccagggagatgcccaatacaaatgcggtgttgatggtgctctgggtcttgggaggcgtgtttggcttccagcagtccaccacgaagtccttggccagtatggacgcaccggccatggccagccccgcgagagaggactggatcgcagcaaagatcccgcagaaaatgatgccgcccatccaggagggcaggagattggtggcgttgaagatggtcgtatagtccgcagtctccaggccggggttaatggcccgggtcagggggccggtgaagcacatgatgccctggatcagagtaaatacacagcaggaaatgatgacgccctgcttcaacttcttatggttgttgtaggtcatcgtgaccgacagggcgtggggtacagcgcccaggcccacgccggcaaacaacgcagtgcccatagcgttccagaaggtgaagcctgtgtccgcctggatcgcgccggggaaggctgtgcccagatactccatggcggcctggacactgccgtacttttccacgttgtcggcaatcagaacaccgatgatggagaacgtggcaatcagcatgatgacaccttgaatgctggccaccttggccatggacttgatccctccggagacggtgtagatcacagtgatgacgatggtcagcaggatgcccaagtagtaggagttggagccggtgacagcggcgaagaccttggcgccggaggtgatctgacccacggcgaaaaaagtcaggccgaaagctccggtgatagccagcgcccccacgacctttttagactggaaccgcagccccaaaagctgctggaacgtgacggcaccggtgcggtcacgcaggatcgccactttgcgccccacgctgcccaggccataggcagcagtcaggaaaccggcgtaatagaccaatgcagctgtgaatccaacggaatacccaaggccgggcgcggccaccatggtgccgccggccatggaatttgtagcggcgatcatggcgatggcaaaggctcccagcccgccgccgcccgtcagaaaggaggccaggccgtctttaccgccctttttggattgatatttgatgtagaagccgaagcccacgataacaacgctgtaaacggcaaagatgatcaacatgacccgagatgtggacgcggttacagagaatccgcccagatcataactcatgcttgttcccctccctctttcttgttcatactgtctttcttaaaccttgcggtcagcggaaactcctcccatttgaccagccagatcatgcccaccacaaacatggccagataaatcacgattgcgccagacacccacatgggcatgcccagaaagtacctcatctctgcgggatcgccggttccgaaggcgtacatccagatggtggcgatcactgtggccaccacccccagcacgtgaaagaacacggcgtcttttttgcccacctccaggcggcggtccagattgcccacctgggcggggtcatagtcggtactctccagatcgacatttgacagttttttgttttccatgattctcactcctttaaaattctcttccggccggcagattccggtccggcttgctgctcttctttttagcaaaagatatgccattcatttattgtccgttttgcctaaattgtccttgcaattttgtcgttttccaagatatattagaaaaaatgccctctgattttctctgattcgcgaatttgtttttcgcatttcggcgaaatgcaaatttttcagaaaggaattgaccacagcatggtacagagaccggaaacacatctggccggggatctggcttcaacccccgcagctcagaaggaatatgagttgttgaagatcttggcggagcactacttcggcagcatgctggtcacggatgaccggggccgttttctctatgtcagcgacggcacctgtcgccttttgggtgtcgaccgtgagacgctgctgcagctctcgatctatgataccctcaagggctactgctttgccaccagcgcttcttccatcaagacgttggaaacaaagcaggagtgtctcagcaaccacacgctgaccgcctccggccgacaggtgcttgccctgtcccggcctcacttcggcccggacggggagctgcaatacgtccctacatacagctgggatgaggaggagctgtacaccttgctggagaagttcgaccaggagcgggacaacgtccgcaacgtcattcgcttcatgcagggcactgacaaaactccatccatgatcatcgcggagagtgatgccatggtgaaactgctggagtatgccgatcatgtagccgcggtggacagcaccgtcattctgtacggcgagtccggcagcggcaaggagatgttcgccaaatacatccatgcccgcagtgaccgagccgatcaggttttcatcccgatcaactgcgcctctctccccccctctttactggaagaggagatgttcggttacgaacggggcacctttaccggcggttccaaggacggcaggatcggcctgttcgagttcgccgacaagggcactatctttttggatgagatcggcgaaatgtctctggaactccaggccaaactgctgcggatcatcgagaccggcgaagtcaagcgtctgggcagcaaccgaatccagaaatgcgacgtacggatcattgccgccaccaatcggaatctgcgggagatggtagaggaaaaggcattccgggcagacctgtattaccgattgaacgtattgaccatccacgtgccgcctctgcgggaacgagtggcggatatcgccccactgacccggtactttgtccagcttttcaacaaaaagtatggctttacaaaacatctgatgcccgctctgattcgggctctggaacagtggtcctggccgggcaatgtccgagagcttcgcaacaccgtggagcggatgatggtggagagccgggattccatcatcgatgcggcggccttccgggaaatcccaccgggcatatcctctccaaaaaccagcgaatgcccagtcccggaccttctgccctatcagcaggccatgaatatctatgagcgggaatacctctccgccatggtggcatcctgcggcggggaccttcgaaaagccgccggaaagatggagctccacctttccaccctgtaccggaagctggagaagctgggtttgaagccaccccggacatccgggaactgccagggccccggagaagaaccgctccactgaaaaagccggcatgaaaattgcttaataattttgacgcggtgttgaacaccgcgggagagaaggaaccgattttgctggagaatctgctgttcagcctcaatatgagcctgcccctcttcatcgtcatggggctgggctgtattctcacccacaaggggtttttcacagagaattacattgcccataccaccaatctggtgtactacgtactgctgcctggaaaaatgtttctggacatcgccaccagcgatctcagcaccgcctttgacatcagatatgtcgcggtggcaacgggcggcgtggtgctgcagttcgcgctggcctgggcagccggctggctgctgtgtccggaccgcagcaagcagagcgccttttcccatgccgcctaccggggcaatttcgtctatctgggcacggctcttctgcgaaatatctatggagtctcccatgtgcccagcgcaacgctgatcctggcgctggtgatccccctttacaatattcagggcgttgttctgatgactgtcaaggagcgccagggccggttccgcctgtccaccgtgcttctgaacgttctgaaaaaccccatgatcctggctgtgcttgcagccatccccttcgcctatttcaagatccagctgcccttcgtggtctctgagagcctgggctatttccaggccgccaccaataccatggcgctgctggtggtgggcggaagcatccgtctcagtgccctgaagaacgatctgccgctgctcatgcgtctctgcggtgtcaagctgttgctgatgccggccatctgggctgccatggggatcgccgccggccttccggcggagcagctggtcaccctgatcatcgtcggcgccatgccggccgccgtcaatgtctacatcatcacagacaagatgggcggcgacggagccctggcctgcagcgccgtagtagtgacccacttgatgtctctgttcaccatgacagccatcatctttgccatgcgcacagcgcggctcatatagggcgtacgccgtaacgttttgaaacattgtctctgttacataagacacgccatgcaactctccggtggtcaagcgtatcctctgcggactatatccgcaggtcgaacaaatatcatgccaatcagcaaatatggaaaggagtttttcacaatggatctaccgaaacgcattgagctgatcgaagtctgccccagagacggcttccagaacgtccatgatatcattccctttgagggcaaggtcgctattatcaagaagctggcagaggccggcttcaagcggctggaggttgtctccttcgtcagccccaaagccatcccccagatggccgacgccaaggaggttgtggccgctgtgcgggatacgctgaaggcgcacggcgtccgcacggtagcgctggtccccaacgcccagggcgtggagaccgccgtggagtgcggcatcaacgaactgacctatgtcatcagtgtcagccgctctcacaacatagccaatgtccgccggacgccggaggaatccatggaacagttcaagaccctgattcaggagtacggccacaagatcgacttccgcctggctctggctaccgctctgggctgtccttttggagaggagatccgcaccgagcgggtggcggaaatggtgcagttcggcctggatctgggctgcaaggaaatctccattgccgacacggtaggcatgtccaatcccaagcgcacctatgacctgatgaatgcgctcaccgcccagttcggagcggacaagttcgtcatgcatctccacgacacccggggcctggctctggccaacaccctggccgccatgcaactgggcgtccacaagtttgaaaccgcggccggcggcctgggcggctgtcccttcgcccccggcgcagccggtaatgttgccacagaggataccctgaacatgatgcatgagatgggcattgagaccggcatcgacaacgatgcactccatgaggcggtgctgctgctccaacagtatgtccacgcccctatcgtcagccatctgatgtccctgtacaagacgaagccctgcgtctaagggatcagcggcacagaatggcaccagcggcgtttcactcgctgctgacgccggtccttccccggacttgggagccttttagggaaaatcactcccatcccagtgcaacgtttttctggtgcatcccttcgctggcgcgtagtgcggacagatttcagtcggtccatccgtatctgcgttcaaaacgtagagcagagaggtatatatgtggagatattgaattggaaagacgttcagcatgtcaacgatatctgtgttatggccccgaccctacagttggcggaaaaagctgagatgctgatcaaacaggagaattatcagaacattgatgtagtggtggccgccagcggccgccaggagacggtcaagtgtgcacagacgctggcagctgcgggtgccgaaatcattatcacccgcaaagggacccgccggatcgtggaagaggtcaccaacctgaaagtcgtgagcctgaacaactccctctctgactatctttggatgctgaaggagcgtggtctgcacacacctggactgattgcttttttttcctatgatcccatgagttctgatattctgcagatgtgtgagatgctggaggtgcagacaaagaactacatcttcaaaagctttgccgactgccggggctgcgtggagcgtgccctgaaagacggcgcggtgtttagtgtgggcggtgcctggaccgatccgtgggccaaaaggttgggacttccccatgtgatcgtggaaaattccgtggagaccattctcaatgcactggagagtgccactcagttgcgccgtgtccaggtggaggaagcagaaaaacagtgcctctttaagactcaatcagagatgtatcaggcagtactggacttcacgcatgacgccatcctggccattgatgaaaacggccggattcaggtcctcaatcctccggcagagcggatcatgggctgccgggccgcggattccgtgggacagccggtggaggcggtcctgcccaatacccttctgccggatgtgctggagagcggcgagaagcagctggaccagatcatgcagatccaccagaccctgtgcaacaccaaccggatccctatcctggtggacggccagcgccggggcgtagtggccacctttcaggacgtgaagcagctgcagaacagcgaacagaagatccgcctcaagttgcacgaaaagggcttggtggccaagtacgccttcaacgatatcctgggggactccccagccatccgcagcaccatccagattgcccggagctatgccgcctcccgtgcctccgtgctgattctgggggagaccggcaccggcaaggagctgttcgcccagtccatccacaacgccagtgaccgccgggacggcccctttgtggccatcaactgcgccgctatcagcaacagcctgctggagagcgagctgttcggctatgaggccgggtcctttaccggcgcctcccggggcggccgggagggcgtgtttgaactggcccacggcggtaccctgtttctggacgagatcggcgagatcccccgggagacccaggtggagctgctgcgggtcctgcaggaaaaagagatccgccgggtgggcggaagccgggtgatccctgtggacgtgcgcatcatcgccgccaccaacaaggatctgctgcaggagaccgtggaaggccgcttccgggaggacctgtattaccgtctggacgtgctggacctgaagctcccgcctctgcgggagcggggtgacgatgtgaagatcttaggcctccatctgttccgccagctgcccggcggcaaggaccccatcatgcagagccagttcttgtatctgcttgaacaggccggtccctatcagtggtacggcaatatccgggagctacaaaactttgtggagcgggccaatattctgatgaggaacgccggagcctcctccgtgacggtgtcggatattctgcgccgccgcgctgagcctgcgccggaaccctgccaggaaacggaatcacgtgaccgccgcgccatcgaggccgctctgcacaaccaccccggctctatggcggatgccgccagaagccttggctgcagtcgacaaactctatggcggaagatgaaaaaatacggcatccaacggtgatcgtttcattttctgctgcgcctttaaccgtttgcaacacacgtttaacaaatcgcgttacactcccccggccaaacgccttgtctgcctattttcattcgcgggcaaggcgttttttgtgcatttttaccccctttttgtaaattttctacagctttttcaaacatttagtcaaatatatgaattttccccgaaggattggcacattttttgctatatctgtaataatagcttttgacgtcgtgggcgagctgcgtctgggcaggtcacaggggatcctgtggcaagactctactatcttttaggaggagattccatgggtaaaacaaaagtccaaaagatcggcttccttgtcggcatcgttgccatgctggtcatcggcttcatgccgacgcctgaagggctgtcgctggtggggcagcgggtgctggccgtcaccgtactgatggtggtcttttggatcactgaggccatgccgatcccgttcacagcgctgttgccgatcttcctgttcccggtaatgcaaatcaccggctccaagggacagaatgacatcacgctgttcgcgcactatgcctactccacctgctacctgctggtgggcgtgggcttcctgtccggcgccatggtgaagcacggcctgcacaagcgtattgctctgggcatcgtcagcaaggtcggcaagaagcccaccactctgatcctgggattcatcattgccgtaggctttgtgtccatgtggatgtccaacacgaccgccactgtcatgatgctgcctgtagctctggctatttccagcaccttgggcgataatgccgccggtctaaagaaagccatggtcctggccatcccctacgccgccaccatcggcggcatggcaactgtcatcggcaccaccaccaaccccaccggcatcggcctgatccgtgagaccattggcatcgacatcgactttctggactggatgaagatcggcctgcctttcaccgtcatcctgatccccttcttctggctctatatggtgaagttcttcaaggtcgacaagatgccccctactgacatctccatcgcccgcaggcagtatgaggaactggggcccatgaacaagggcgagaagtgggttgccgccatcttcgttctgtgtgtcatcctgtgggtcacccgttctctggtctggggtgactggttcccctatgccacggatgaaactatcgccatgttcggtgcaatcttggttatgattgcacctatggattataagaaaggtgagtacgtctgcgactggaagaccggcttcaatgacatcccctggaacgccgttattctgctgggcggctccatggtcatgggcaacgccttccgggatgccggttgcgcggagtggatcgccaatatgctctccggcttggcgggcatgaactccatcctgattgtaattctggttggtattgtcaccgctgttctcactgaactgactaccaacgccgtggtcgtggccgcctttatcccggtcctggccggtgtgggcgaggctatcggagtcagtccctttgccatgatgatcgcctgcatgttggcctgcaactttgctttcatgctgcctcccggaacgccccccaacgccattgcttatggctccggcgaaatcgagctgaaagatatgttgaaatgcggccttggcctgaagctcatcgctctgatcatcttccccatcgttctgtatttcatcaccatgggcatcttcggtgtcggcacggtttgaccgtccctggtacatctgtcacaagggctccgcacagtatgtgcggagccctttcctgtccccccgctcctccgctccagcgatccagctgctggagttcacaggcacagcacaggtgtgcggaccgatccacaccgtctcttccagctgtctcacaggcggcctcaggagaatcatagggtacatacaccccgagtacagagtctgtaatccccagggccagcccgtccaaagccctgtgcgtcagccctttctcgtgcgatccccctgtgttcttctctctgtacgggctctgcgtaagccgccgcagaatccccgcctgcatcttcttcgcccagccctgcagaaaaaccccgcccccttccatttgggaagggggcgggaaggagtgtgtgttagatgacttatcgctcaggcttgcagggagtctctttttctacatggatatggtggccgctgtatgtaccagggatggcctgcatctgggccttcgcagcagccagcagcttggagaaggaaatgccagtgtcgcagcccatctcattgagagtccacaccacatcctctgtggacagatttccagaggcaccgggggcaaaggggcagcctcccagaccacccagagcagcctgcaccttggtaacccccatatccatggccgccagggtgttggccatgcccaggccgcgggtatcatggaagtggaccatcagatccagaccgggatatgcgttcttcacggcgccgatcactgcgcgcacctgggcgggatcggcaatgccgatagtatcgcacaggcagcaggtcttcataccggcgtccacatagtctttcagaaaatttaccgcggcggagggattgtcgtatttcccctcaaagggacagccaaaggtggtggccagatccacgatgatgtccaggtcgggataggcagcccggatttccttgtacgcctccagagactgctcgtgggtgcggttgatgttggccttgttatggctcttgctgagagagaccacatagcacacccgccgcaagcccagctcataggcgttctgtgcgccccgcaggttggggatcagtgcgaacagatccatgtctggatatttctccagcaccacccgggtcacgtcagccgcgtctgccagctggggaatggccttggggctgacgaaggaggtatactcgatgtgcttcactccggcagccaccagttgatcgatgacggtcagcttctgctccgtggtgatcggggtgcatttgacactctggaatccgtcccggggccccacttcgatgacttcaacttgcttgctcatgacaggaaatcctcctctaaaatcagataacgcctttctccttcagctcggtcagtttggcctcgtcgaagtccagcatctcaccgtagatcgcggcattgtcctcgccaagcaggggcgccccctttctggggcaggacttggtgcgggtcagcttctgggccatggccgtgatctgcagcttgcccatgccgggctggtcgatctccgggaacattccgcggtcgccggcgatctgggggtccttcaccagacggtcaatagtgttcaccggacaggccgggcagccggcgtcattgagcatcttgtcgatttcgtcaatggtatggtttctggtccaactgctgatgatctcccgcagctcctcgtgatttgcgatgcgctcctggatgcctgcaaacttgggggcatcagccagctcggggctgcccatcacactgcacaggatcttccaaagcttggcgtttccggcggcgatgaccacgtcgccgtcactggccgggaacacatcatagggataggtggactcataacggttgccgatccgctggggatacggccggtagactgatagatcatggtgatattctccatagcggaggccacagagtccaccagtgccacgtcgaccttttcacccagacctgtcctctgcttgttcaccagggccgccagcacgccgacggtcaggttcagccctcccagcacgtcgcccatgggggtgccgcagcgggtggcagggccgccaggccagccggtggtgctcatcagtccgcccatggcctgacctacaatatcataacccgcacgcttgctgtatgggcctgtgtggccgaagccggagcaagcgccatagatgatgccggggttgatctccttcagcacatcatatcccaggcccagcttctccatggtgccgggacggtagttctcgatcaccacgtcggccttcttcaccatctccttgaagatctccttggcctcgggggctttcaggttcagggtgacgcccatcttactgcggttaaagttggcaaagtaaacgctttgatcattgataaaggggcccatgctccgactgtcatcacccttgccaggctgctcgaccttgataaccgtagcgcccatatccgccagcagcgcaccgcagtagggccctgccaacacgcgggtcagatccagaataacaatgccttccagcaggcctttttcgtgctccatgataaaccttccttttccgtcaataatatgccttcagaattggcctatcgctctgggggcgagaccagaggagggccttatcctatcgggatattaagcaatttttgtgccaacattttggagcagcccagacgtcgtaataccacagatatcggtctgtttttttgaaccgtccgctatcaagctgctaatttgtatcagtaagtattaaatgtaccgtaacatattgttacatcccgtaacacttcaagaagacctactgcggagccaaattttccggtcggatgcgcctatcgtccgcagctttcaactcctgagagcatggcgttcatgcgcctgggaaatgccacattcgctcccatctggttctattggcagtcatgccgatatctgagcaatgttccggtcgatagaatgctgctcctttattttacagtagatattgaaatgaagaaaatagcgcctcatccgccttctcccccaccaacctgcggctcttccttgatcattcctggaattatgtggtgccagacattgatctctctggctgaatgagctatcagtgtcgacaggttcttcacacagctcctctcaatttgcagcctgctgccggcaacatacaactgcatttttgacaaacttttcccgctgagatgggcgagcccttgccctcatttcccaaacttatcgggaatactttttccgctcgtttatagcggttttcggcgctttttaatttgtttcacttactctttgacgctcttatctccgctgtttccgagtgttccggagccgtatgtggtaatctatgtggtcaaaaacgcttcccgcccggtttccggtgaactgtcaccggggccggacgggaagcgttttgtgtttcaaatcgtctgcattgtaactctgcggagggtgttatgcaagtggtttctgcaagggtgcggctcaaaggttgagccgctatagacaaagaataggcaggaagataagcgaggtacttttcgtgctccctgagtataaattccttaatacaggcataatagtaagggatttatggcacagtctattgactattcccttatttcgtattactatttaagggaaagcgaatggaggtgagggaatgagaaccttcaattactctgcaattaaggaacagaagtgggactcggatgttcttggcctaattgcggccatatacaaggaagccggaaagcaagaattgtatttgaagcagcgtccggaggaacttgaaaagctcgtggagattgccaagatacagagcactgaggcatcgaatgccatcgagggcatcgtcaccacgagtacccgaatccggcagctcgtcgaggagaaaaccacgccgaggaaccgagatgagcaggagatcgctggataccgcgatgtgctgagtatcattcatgagagctttgacgcgataccaattacgcagaactatatcctgcagcttcacaaaatcctgtacagccacatgaataacccgcttgcgggccgcacaaaaagcgtgcagaattatatcactgccacctatccggacggtcatgtgaaaacgctgttcacgccgcttgccccttatgaaacgccggaagcgctggacagaatctgcgaggaatacaaccgtgtgattggaaatatggagctggagccgttgattgcaatcccggttttcatccatgacttcctgtgcattcatccgtttaatgacggcaacggaagaatgagcagattgctcacaacgctgcttttgtaccggagcggattttatgtcggcaagtatatctcacttgaagccaaaatcgccaaaaacaaggatttgtactatgatgcgcttgcacaggcgcaaaccggctggcacgaaggcacagaggatgtagtgcctttcatcaagtatctgctcgggacaattcttgcggcgtataaggactttgaggatcgcatggcgcttgtggaaaccaagctgcccgcactggaaatggtgcgcagagcaagcaagaatagaatcgggcggtttaataagcaggacatccgggagctctgcccgacgctcagcgacagttccattgagggtgctctgcggaagttagtcgccgttggtgaactgaaaaaagaaggaaaaggtaaaaacacctgctatttcagactgaattaaatttccgtcaattagagggccgcacctgttcatacgagcaggtgcggcccttttagtcgctttatagtagttggcgcacagtttaagggttgagccgctataaacaaggaatacaccaaagtctcctgccggaacacacacttgccttacccgaagaaatactgcttcatatctgagacagcgccatccttatcgcagaaccattcataattagagagacaatttcggcagtgagcaatcacatcgaagccgccgggtgaatgccagttgtcggtaatgctcatgatctccaatggttttccgcaggctggacatagtctgattttccttgccttacgagtggcacgctctctctgttctgtctcaagtgcatctaaaaggtcatgccaaagattcggattcggctcgtgttctgcgtaatcttcaagatgccgcctaatctcatcggcagccagtacgagaaacttatcatccagaagctgagtgtgacgcttgatataatcagcgactaccatgggcatacaagtattcctgcccatcgcataccgcattgccgacagcagaatcaagcgaaagtcagagtcgcagattggggcgagcagatcctgagggaacagcagaaactccttgccattattcatgcatacgcgcagcggccgctgttcttccgttaccagattcagtagactgttagcttgatccttcagctcatcaatggtgatcgattcgtagtcctgaaacgggtttacttcataattcatcatttaacctccaatcagtttgtcctcacgatgaggtgttggcattgtagctctgactgcccggaggttcaaccgtttcttttgcagctcgaaaagaaatccaatagggtcggaattcgtgcggatttatcattttcttgcttttcctgcccaaatgtgctatcattataaacaacgctgtcaagtgttggaataggccttggcagtatggctgcaatagaccgaatgctctgccaagtggcagagcatttttcgcatatcggtacggaggagatatttatgtctgtgagttataaaaaactctggaaactgctcatcgataaggacatgaagaaaaaagacttatatgaaaaggcgggtatcagcccagcatccgtcactaagatggggcggaacgggcatgttaccacggagattcttgcgaagatttgcgctgcgctggattgccggatagaagatatcgtggagattgtgccggatcctgataagagtcgttaaatagtagaatattcttgataacaaagggatacatatgggaaacatcattcagtcgattccggaagcaaagcttctattggcctctttacgctccgttggatatacagaggaaaccgcaattgcggatattgttgataattgtatttctgctaaagccaagcatattgatattatctttgagactgagaaaatgcgaattctaattcttgatgatggtattggtatgacagcacaagccctaatagagaatatgagaattgggtcttctgatccgtcgaaacagcgggatgatactgatcttgggcgatttggtatgggcatgaaaactgccgccttttcattggggaaaaggcttactgttgtaaccagatttgaggaatctaccagtaacgctgcatgggatttagacaaaatacctgatattgggtggaatcttattatcgaggaaagtgactcaatagccgagatttcatccaggcttggagcgcaaggtactgttgtttgtattgagaatcttgatcgagtaatcggttctttagatgaagcgaaggccaaaaagaagttttgcaaaacagcggaaaaagttgaaaagcatctcgcccttatttttcatcggttcattgaggaagatggccttgttattcgcatcaatggaacagagattcaaccatggaacccgttcgttatcaataataatgccactcaagagcttgcagatgaaactatatggtcagacgatggtgcatctgaagttgtaattcagccatatgttcttccccatagaaccaagtttgcctcggatgatgactatcaagctgcgggcggtgcaaaagggtggaactatcatcagggtgtgtatgtctatagaaatcgtagacttataatttgtggtacatggtttgattatatcaagaaagagccagcatacaatcttgcaaggattaaagttgatatatcttctgttagtgatgaagagtggaaaattgacattaaaaaatcaacagcctctttacctgggtatgttcgagacactgtggaacgggctattgatatttgtacggaggcgtccgctcgtgtctataactcccgtgggacatactcaaaatctaatataagtgcaccgaacctaagttatgtttgggaacagcgaaaaaagaatgggcgctattccttccatattaaccgtaaacatgccttgctcaccgaggtcaaaaagcatcttgacacagatggcgcagctgcgttgtcagcgtatttaactctggtagaaaattttgcaccgtttatgctgtctggtgtaacagactcgctgcaaaaatcgactgaaactgcagtaaataaagcctcacttgaatatcaagtggagatatccgaattaaaagaatacatcgcgttgtttctgtctcaaggatttacaaaagaagaaacaaggtccaccttactggatatggtgaattaccgtcatctccgtaatgagattattgagttgttggaggaagccgaatgataaacgtgcctaagggcttagccccgcatgaagttgatctttacataagtgccttcaagttttgcgaaaagttaattcaggaacagaatactgatattggcgctgcagtaacagagacaacggagaaatacagctttattatttcggataaagagttatttgcacagtttctttttagagaaatcactgcatataccgagccatcaataggtgttgtgtccccagaacttgatgataaaacttggtggagtaaacttaaaaaaacggaaaaattcatacctgagtattggcagcgatattatgactacttaaatagaaaaccttcttggagtttaactgcagtgcaggatattgattcgtccactgacgagataatgaacgcacttgcaaacccacgaagtggtagagcatgtgatcgcatgggcatggtctttggttatatacaatctggtaagaccgcacattacattgggctgatcaataaagcggttgatgcggggtatagaattgtagtagtgttgactggcattcataatagcctacgcagccagacgcaatcacgtattgatgaagaagttttgggctatgagacaagcttggaaaacttggccgatatgattagggaaccgaatgttattggtgttgggataggtgcgcacaaccgcgtgaaaacgatagtgcagtccattacaacccgtgatgaaaaaggcgatgtaaataaaactacagaaggcgtctccatggttccgccgtttattattgttacaaagaaaaatgcaacggttttgcgtcgtatcctgcgctttttccgaaaaaaccaatgtgccgaagtaattgacggcaaaaaaattataacagctaaatatccggcgctcataattgatgatgaagcagaccaggcctccattaatacaaacgatagttatgatgagaagggtaatcttcttgatgattataatcctacaacaataaatggactgattcgagaaattcttaaaacatttgagtgcagatcttatgttggatatacagctactccgttcgccaacatttttataccaccgcatattaactctgagcgatatggaacagatctcttccctcgcaactttgttttcagaacaccgcgggcggatcagtatatcggtgcccgagagttttttggattaagcggcgatgaaaatacgccggtaatgcctttgtgcagagatattatcgcgggagcttcttaccttggtaagggtactaaagcaggagatcctgttggcaacataccagaagagctaaaaaaagcagtgaaatgtttcttgatatccaccgcgcttcgtaattgcagaggacaaattaataaacccaatacgatgttgattcacattgtgcgtttcgtttctcagcaaaatgcagtaaaaaagaaagttgctgcatactaccaagatgaacttgccaacttcatccgatatggcgactcaggtatctatgatgaactgaagacgatttgggaaaatgattaccttgagacaacagctgcattacgttctcaattcagtaaatatatgtctgattgtgcagatattgaatgggatgatatttgggatgaaattaggagaatcgtagcaaagaaagaaattaaaatatacagtgtcaacggaaaaagcgaggatgctctgctatacaaaaacaacgaaggaaagccatttaatgttattgtcattggcggggacaaactgtcccgaggcctgacgcttgagggattaactatcagttacttcacgagaagctctaatacttatgatactcttatgcaaatggggcgctggtttggcttccgtcctggctatttggatgcgtgtcgcctatatacaacgccagggctaagaggacttttttctcacatttctatggcaaccgaggacttggctggacagtttgattttatgaatgatgtagatcagactccagcagattttggcctgcgtgtcgcaagtcatccctctttagagattacaagtaaaaacaaactaaagacgggtcttgaggtaaaaagagacttcagctgcaagcttagccagacacgcgttttcgatattgacggttcccaatatgaccgcaattttgcaacagttgagaatctgctgtattccatagcgggatgcagagtttcaagtgaacagtatgaagctcgtcttaagagaacgcacccaggtgatcattatttttggatggatgtatcggcttatgatgttgctaatttcttcgaaggctatgaaacatcgaaaacggctactcgcgccaatagtaagtatatggcagactatgtgcgtgcgatgaatgtagatggtcttggcggagtaaaaaattggaccgtctgccttataaatgtcagcggaaacggagagccattttctattgcgggacttgatgttggtgcgggtattctcagaaaagaaggtgctggtgtatcttcttttgagacaacctgttcaatacacaccatgacatccgctgggcacgagtattttgattacagtcaggcacagctcgacaaggaacatgagctccgagaaatgtactcggctgatccatccattaatcgggtcaacgaaaaaattcgaaaggaaacgcggtcttttgatcaaggattgttaatcctctatccaattgcagatgcaggaaaactaactgctcagaaagaagatcacaataccccatttggcttcgcagctgtgtttcctgatagaaaaggaaaaggtaatctaaagtcttatcggatgaacgatatagcactggagaaagataacgatgagttttacggctgacatctataaagaaatatgtacggatattgcaaaaaactctcggcctaattctgtttacgccatgagaatgttgaaactctccaacggaattaatattgcattctctattaatacacttacatacatgcggggagcgtttttctcagttgacgctaaagcaacggcaaatcaattccctcgctggaaaggcgttgacatcgtcatcgctaaacttcctgcctatggtactgatcaggagtatgtaaatgtaatgcagttaccaggaagtgcaactgatattttcgaaattgtcattgagaacttgcgaagcgaactggagaaatgctccgttgcagaagactcctttgcagttattgctgcggttttgaccaaatggagagaattcttcaagacagataaagatcttattatgtctgaagaacgccagcaagggctgtatggagaactgctgtttttagaagaatgccttgaagtatttggaccaatggctgtttctcaatgggctggcagtaatgacgagactcatgatttctacttctcgtctaatgcggttgaggtgaaaacaacttcttctcaggctccgtactatgcacatatcagcagtgaatatcaacttgacaacaatgatattcccggaaagttattcctgcgtttttatgcgtttcgaaaaagtcaaagtgcaggggataagctgccagacattatagagcggatccgtcgggcaatttcacatattccacagacagcacagaccttcacagaaaaaattcaaaagtatgggtactatgatgcggctgcggattattatggtgccggttattttgtccgtgatcaatactattttactgttaaagatggatttgcacgaatcacaaaagctgcggtgcccacaggtgtaacagatctaacttatacgattagtgttgctcagtgcatgccatttgcggtcaacaaaaatagcgtgtttgcaaagttgaagggaggggttaacaatgttgaatgataaaatattggagttttacagcgaactgcgcgaggaagtgcaagattatgtgaaaaccaacggccccgtctctgttaacacagcgtttaagacacttttcttgtcatatctgactgaaaccggagaaacacttgtttcggactgcactctcgttgatttcaaaaaagattctgagaatatgcgtttggacggttatgccttcagtgagtattttcgttcattgacgctactcgtcagcaagtatcaggctaaagccataccagataaaatcaaaaaaacagagcttgataaactgatgcgaaaagcagtaaaattctataagacctgccaaacgaattatttcgaggaattagaagagtccagtgatgggtatcaagcctatgagtttattaaggcacatagagcggatattgagacagtgaatattatttttctgacgaatgacgaagtggtacaattcgttccagaggatatttcttacggaaagatttccattaagtttgatgtctgggatattgaacgcctttatcagagtatattcagcggaacagcagtagaacgtcagcttgttataaagctaaagaagaagtatgctgctccgttgcatctaattaaagtaaatgggagcaatgatatctatgactgctatattggtgtcatttccggggaactactggctcgcatttacaaggatgaagggcaagaactaattcaaaagaatgttcgttcgtttctgcaagcaactggcaaggtcaataagggtattaaaatgtccttggcaagtagtcccgaaatgtttatggcatataacaacggtatttctacagttgcagatagtattgttattgacgaagcaagcagccatgacgatttagtgaccatcaccgaaattactgggtggcagatagtaaacggcggacaaacaacggcgtctatttataatgcatttcaagcaaaactgcctctggaaaaagtgcatgttcaaataaagctatctgtcattaaacagaaagagcaagcggatggtattattcagaatatatctaaatatgccaatagtcagaataaaatcaatatgtctgactttaatgcaaatgatgtctatcatgtgaaaatggaacggctgtccagaagtacctatattccagtagcaaaaggtaagcctaccgatcagtggttttatgagcgtgcccgaggtcagtaccttgttgaactgagcagacagccaaccaaagcggcaaaagatcaattcaaaagtcgatgccccaagaatcgctgtatttcaaaaactgttgccgcaaagtgcgtcatggcgtggtctggatatccatatatcgtaagcaaagggctggaaacaaactttgtgtttttctcagatatggtttccaaaggcgaatttccagaaccgtctgaacagagttacatcgaaatgatttcaagagtgattttatttaatcgatgtgatgatattataaaaagcttgaaattcggtggtttcaaggctcagcaagattactatactgttgcgcttatcgggaaatactattcggatcttataaatcctcaggaaatttggaacaatcaagatattaatgcagaaacagcgaagataatcgaaaccttggcttattttgtatgggagcatttccaaaatcccagtgtacccggtgtgaatatcggtcaatggtgtaaaaaagaggattgttgggaactgctgcaaaagcgctttgaagcacaaaaagataaagcaggagcaagataagatatgtacacagcggtagatctgtttgccggagcggggggactcagtcttgggttcatgcaaacaggaaaatatgatattaaagtggcttttgagaatagtccctatatgcaagatacatatcgcttgaatcatccaggcgtagaagttttaggtgatgtatgctcggccaactatagtgacattatgcgcaaatatggcgctattgatgttgtaattggtggccctccatgtcagggattttccaatgctaatcgccagaaaaaccatgcgattagccaaaataatatgcttgtgaagcaatatttacgtgcaattttggaactgcaaccaaaggcttttgttatggaaaatgtaagcatgttgagttccgaagtacatcgattttatatggaaaagcgcgatgaagagaccattgagcgctgcaacatcccagtaaaggatactcttctgcatttgctggatgcgaagtttatgttcgaaaaagcactgactattgtgcagtcggaaaaagaaatttcgaagtatctttgggcagaagaagattattacctgttgaatgttatttacaaggcatcaagaagcgccgctaaaatgcaaaaagcattggataaacataagaaaaaattacttaaaagagcagagcggtatttaacgattgcagagaatgatcatgtttttgcagaagcaaaaacagcatttcaggcggtagtggacttctatgagggaagactggctattgatagaataaaagataagattgaaccgtccataatgatccagcgaatgctgagcaaggctcaagaaatatttgagaataacattgttgtagacaaatatgttcaagataatggcttagccgcccaaatacgttcattcgcagtttatgattacctgaaaaaaatcctcgaagctccagaaaatgattacgtgatttatagcgatgttctttgcgctgctgattatggtgcacctcaaaaaagaatgcgttttgttgttataggaataaaacgtagtatttctgcaaaaattgctttgcccaaggggcattttgacgcagatgaatatcgtacagtaagggatgcaattagcgacctggaagatgtcaagccggttattgatcttgctgatgaccaaaatggcattgtactacagcccaaggaaaaccttagtgaacttgcttcatctttgcgtaactccttaatcctaagaaatcacatggtcacgaaaacaactgatactgcgatggagcgctttcgtgctcttaaacaagggcagaattttcattcacttaaagactctatgaaaacgaatacctatacagatgctgcacggactcagaatacaatctaccttagactaaattatgatgaaccaagcgggacagtggtcaacgttagaaagtcaatgtggattcatccaacgcaggatcgggcgataagtgttagagaagccgcgcgattgcagacattcccagatagttttgtgttctgtgggtcaaaggataagcagtatcaacaagttggcaacgctgttcctccaattatggctaagtcgatagcagaaaaactcgctcagattttggaaaagaatttagctggtcgtgaaagaaatggctgataatcactctaaagaagtccggagcatgaatatgtcccatattcgcagcacaaattcaaaaccggaagaaattgtgaggaaatatcttttttcacaagggctcagatatcgaaaaaatgtgaagaagctcccagggtgtccggatatagtgctgcctaaatatcatactgtcatttttgttaacgggtgcttttggcatagacatgattgctccagatttgtgtggccgagttcaaatcaagactactggagacctaaaatcctgcggaatgttgagcgcgataaaaagaataccgaagaattgaaggccttagggtggaatgtcattacagtttgggaatgtgaactgaaaagagctgtgcgagaagaaaacttaaatctgcttataacaaaaatccaacagagtaaaagctaacaaacagagaaatgttttgattctgaaatcttgcttcttgaaggggcatagttaacctgcgagcccggttgaagcggtaaacaacccccgcacttaaaactcaatatttacattctcttccatatgggggtatagctcagatgggagcccgcatcatgagtaccccacatcccaaatagcgactgaaatgcaatgcttcagtcgctatttttcttaaaaatttcagtagctattcctgctgacctgtggtatatgtttgtgctgcaaggaggcgagcacatgaacaaactgctgaaggatctgtacgactgcttctacaccccgccggagctggcggcgacgaagcgggaaatcgaagaatgccaccgcgcgctcattgaggcgctgggcaagccggagcgccgattggtgctgaagatcatcgatgccaaggatcatatttcggaggacacttcgctcgacagcttcatctccggatttcggctggcgtggcggctgtccgcagaattgaatcactatgacgatgagcgtccggcgcgctgccaagcggcagagaaaccgggcgctcgttttacgttcaaaaaggaggatgatgaacaatgaagaagcgcatcgtgacagctgtgattaccgcttgcttggccctgtgtgccgctgtgtggccgcagccagacacacgggaggaacgacccgccccaataccaacgcacgccgcagctgctccgaaaacggatgctgtgacaacggcagaaaggaaaaatacggaaacgccgcgggcagagccggacgaggagcttggcgccgttcctgtccccacaccggcagagccgacacctgcggtcgaaacgccgcagccggagcctgcgcctcccgcaccgcagccgaccatagagctgcagcccggcgacgaggtctatattccgggctttggttgggtaccatacgaggggccgaatcaccgcgagtatgccgcggatatgtacgaaaatggcaataaaatcgggagcatgggctgaaacaggagctgctgggagcggttaagctgcttgattacgaaagttgctgcaccgaaaagtggttggtatcaaaatgtgataccaaccactttttttgtcggtgtggaattgaaaagcgccatccggcgcacgatgaaagaactcatgtgcgcacctgcttgcggggcgatagtgtggggatttgtaatagaaaccgcggaaatcggcagtatcgtttctcaatttgcagttgcctattgcatttgatttcgatttatgttaccatgttaatgctgaattgttggactatcctaagcttcaaccattcgtatcatgagagtacgaatcatattgaacctatgtagtgatatagacaatttagcggacaaatgagtaaatcctcgaaactattgattccaatcaaattctcattatggaattgagaaagcagtttgctggttgactgtcgttgtccccctgttgtttcgatgctttgcaccacaaaatcgaaccggagaaagtgttctttcgtcgggtttgttttgttgcgtgcaaagcggtcttccggatgatcgcagtccacgcacgaagcaaagtgcgtgggcttttttcggttcagaaaggaggctgattatgggaaaggtatcaggaaaaacacataccaaagcacaactggatcactgggcaaatctgcataatcccaataacaaggcatatcaagctgacgctgacaatcgggccaatcagatgaatccgaaccacagatcgtaccagagaactcacaatgcaaaccgcagaaacaaagcgcattggatgcccgagtgggcgcctgactatccggaatacgatgattaaaattggaggtgcacggtatgtcaaagtacattttcgactacgatgacggcgacttcgccatgagcatttctgacagcatggcgatggactccgatgggaatctcatgatgcgcatgggagatcacatggcgatggacatggacaccggggatattcacatgatctcctcgtggcccgatgatgacgaggagtagagcataggcggcagctcagcgattgagccgccatagacaaggaaaacactttcaatccgggcagagaaagcagcgggacaggccgtaaaggcttgtcccgctgtctgtatcctatggcagatattcttctgtgatccgataccggctcatgccgaaggcgctgctccgctccacgatctccggcgggatcttgggcagatatttcttgctgaagctggtgtccccgaagtaggcgtcaaagcttgccaccggcaggacgacccattcgctatcatcctgacggttggcgaggtaatagcggatcagcgtacagacgacctcggctggaatttccttcggaagcgccgctttcactttctctgtcagttcaggcggcagctccggctcctctctgcgcagcggtcccagctccaacgcatcggcaaggacatcatcaaagcgcagtgtccaggcgcccttggtttgggacgcaaaaatcgggatctgatattgcatcaccttgcttcgccatgcggcggcaaactttgagcgaatgacctccacatacttgagcgaggtgctgcgcaccttttccgggtgcgtcagcatgaagtccgccgcacggagaacatgacggaggaaccagccgaccccatccgcatccaccagctccgggaactctgtatgcagctccgaaaagtccgtctggaactgccactccttgtcctgcacacgctttccgtcctctggcacactgcaccaggcgcagagcgcacggcgggcgtggtcgatccgattatgcgaatcacccgaaaggattgctccatcctccccgtggaacaggtatccgcgggccaggatggtcagaatccgagccattccctcaaactccaggatcgtggcaaaggtgaaacggcccagccatgtcgtatcgctcttcctgctggcggtataggaaaccgttccggtatatgcgcagaattcctcccgttcgttaatcatcccgcacctccagaacatttttctcgatatactccggcagtagatcccacagcaggtcacgtctgccgagagcgaccacatagcgcacggccagagccggtcttacaatcgcggtcaataactcccggcacttagccgtcaccgcatcacggtagctctgggaggcggatttgtccgcgaaggcgctcatcatggcggtgaaggctttcgagtcgctttcgcggaacagctgctttttctccctgccggtgttctcttcctctatatcacagacaatgtctccgaggatgcggtagccgccgaagcggaaatcggtcagcagatcgtaaatatcctcaaactccggcaccggcagccattcccgcaggaaacgctcccgtgcatcctcgtccatgaggtgccaggcctgctcccgcatggcatacagcagggcggacaccttttccggcggcaggctgccgaacagagcgtacagctcgtcaggatcgtatgcatcctcctgccctctggcatatagaatgcgctccacatcgctcttccgctttttctccttcaacggaacgcggcaggcccggatgcgggagaggcaggcatcgtaatcccgcagcagcgcatccactgccgccagcttatcggagtttaactgttccttccagtccggctgccgagcgaaggaaaacaattcttcgtccttggcgggctttgccttgatgcgcggcgtgttctttttcagctgctgtgccagatacggcaggcgctccacattggagtccacctcgtcccaatccacctttttgaaaaacgcctttaccttggccgcatgggtaggctcgtaccaggcgcgccgggtctccgcctcctctaccagcgtcttatatttgaggaaggcactgcgcttgacggtcttgtgggtcaggtactcatccagatcggggcggatgccgctcttagccgagtcgatctccagcccggtaaggatggctaatgtttccgtctcctcccggcagcgctcccgctcctcggcgtcggagttttcgttgtaggcaatgatgctgcgatccagcgcggcattgcagatctgaccgacgcgggaggaaaaggtgctgcgaacggtctcaaagcgtgcctcccagtcgtcggcactgcggatctggggctgggccgtagggatcatcagcagaggaatgttctctgtgttggtgagggatttgtgtttctcgtagcggtagaggttgtagttgcggcggacgcaggcattcaggattggatcagatatggtcttgatcatatcaccgtcgtagtcagcgccgcccagccgctccgcagccagcatattggaatccaccatcaccacatccgtcaggtgcccgaaatagtaatgccgcatctgctttctctcttccttcgcgtcgtagaaggaaagctgtagctcctcgttgcgggcaatgtgcggattgcgtagcagcgtgcaggcgtcgtcatgggcataggccgcttggggtgcatagaaggaactctccgggaagtggtcggtcatgacggtgctgtaaaacatccgttgcctgcgtttgcgcggcggaacagtcgggagcagaaatgccagaaagtccagaagatcaccggaaagataacggttgtctcccgccacgatcaggcggccgacggcgtactgctccacgatcttgtccgcttcgtcctccagccgcctggcatagaccggttcgttgatgaaatgcggattctttttcagcacggcggcaagaatctggtctttgccctgatgccgttcccaccagctgatccaatccgctttctccagaaagtagttctgccgaaattgcgggtttgcgcagaggttatagtaccgtagctccgtctgcttggtgagccaatttcgctcgtccgtctccgggctgtgatcccagccgtccggcagatcggcggggcggaactcgtcaccctgaatggaaacggtggtcagaaactgatagttcagctcggtggtctgttccggtttctccttgctcacattggtgatgtacagcgcatggcggtacttgcgaaacaccgcccggtagtcctcccagttcatgccactggcagtgagccagccgtatcccttgaacatgctcttggtgaggatgacgtccacatcccggacggaatgctccatgccccacagatcggtgatggtgtccgtcccgcagagggtcaggaagtctttgaagtccacctcgtgcagcatacccttgacatagggcatacggatctggaatgaggtgtggactttcttcccgcacagcttctcgtccacgacgcgggcatattcttttgagatcagcccctcgccgtcgaagcaggtgatttcgatgtcctcttttttctccacccggtgatatttgcgggtactgctctgcgttccgtcgtcctctacggtgatgacgctgacattccgctctgtgcgcgtaggattgtcgatgaccaccacccggtggggccggtcaatgccgatgccgtcaatgcggataccgctggacagcatcagtccgttgtaggcgtagagtttgctgagctgacagtcaccgatggtcatatccatcatgatgcgtcgacgcacggcgtcaaaaaaatcttcccgaatgaaggacagccgcgcctgccggctcatgctgcctgaccgctcaaaggcgagatatcgatgcgggtcggagccaaaatcaaggctcacgccctcgggacggaacagggccttggccttctcctgtcgaatcaggtgtttctttctggcaccgctccggtcgaatatgccggagaagtccatatagaaaatgacatccgaaaggtcggtcaccagctgcccttcaggtgctccggtgaaagcgtcgccgtgcagcacgcacatggtctgatagaacagtgcgttatcgtcctgctcatggggcgcggaaagtgatttgcatttctctgtctcggcggcgctgagatggaaggtatatgtcccgtcctgctgcctgccatagctgatcacggctctggcggacagctcgtagatcctgtatttcatcaacggcatcggctcacctcctgatgcttctattctatcatgaggttccaaatttgcaatatggatactgctcccactttttcagtgggagctttttgcttgcagctctcaataaaaattataaaggaggaatccaatgcaagaatccacattcaccaactatgaccagctgccgctgttcctcaacgcgaacacggtggcgcaggtgctgggcgtgtccatctccagcgcctacgaactcatgcacgagacgggcttccccgcactgcggatcggcagccgcatcgtggtaccaaaagaaaaattccgccgatgggtcgatgcgcagacaggaggtgatgcctgatgttccagcgctggcctaagcgggatccgaacaagcactactatctcgtcccaaacgaagtcttcaatctcggtctcacttctcacgagattgccgtctacaattaccttctgcgctgcgaggatcgcaggacctatcagtgccatcccagctaccgcaccatcggtcggtcggtgcagctgagcgaaaacaccgtgcgaaaatatgtggccgggctggaagagaagggcctcatccgcacggagcccagcaccatcaccacgaaggacggccgcgtgcgcaacggcagtctcatctataccatccgtcccattcaggaagcgctggagctgaactaccagcggcaatttctgcaggcggagcgtgatatggagcgggcacaggcagagaagcggctggtcgagttgaatcagcagaacaaaaaggaggaaagcgcatgatgcagcaacttgcgaacttcattgtagaccatgacccgatgatggttctccgtcgcacgcacgacacgatgcactacattcggtgggcgtggaacaaggatcatgccgaccccatcgacgaagaagagcttcgcctgttcctctgcgatgagcactacggtgatctgaccgatgagcaaaaagccgttgcccgtcggagccgggacgagatgcgaagtgtctatgcggagctgtgtgtgcgcttgctgcaaagtgagatcatgctggagcgtggcatggtgccggacagcggtacctaccgcagcgtgttttgcccggaagggggtgatgcgccatggatgcttgaccaagcgggatgactgccttttccgcaaagcgccgcagagcggctgaagtgcgcgtcagcgccgaaaattctcgcttcgagaatgacaagtttcgccttcgtggtacggaacggggcgattgccccgttccgaccccttcggcaggcgggctaagcccacacccctatcaacacaaagaaaaatgaatttaaaggagataaagattatgacgaagaacacctataatccctatgaaattatgatggacaagtacgataaggaagagatgctcagcgatgtacgggaagccatgctctatcaactcggcgtggatgtctcctgtgaagagttgaatcactttttcaccggcaagggcaaagccgcactatctggctgtgcggagtggcagcagtgctttgcagtcgaaaagatgctggagttctattatgtgcatgcgcgggacgagactctggctaagcagatcgagacgatgactatgctggcaagcagaggtaacgagcaccatggctaagaatcaatttatccgcgcccgcgttgccgggtgggaaaaggactgcatccgccgtaaggcggatgcagctcatatgaccgagagcgagtttgtgcgccgggcggctatggatcgtgaggtcacggtcattgaaggtatggatgaacttctgcgggagctgcgctatcagggaaataacctgaaccagctcacggtcatggctcggcaggggcgtatcacgcaggtgaactatgaaccctttacggaggtgtaccggaacgcatggcaaacattaaattcattgctgtctcacgcagtctgagcggtatcctggactatgttacaaaccgtgagaaaacggtggagcgtctcatatccggtgtcaactgcatggctcaaacagctcaggatgaattcgaagcggtaaagaaacagttccgcaaaacagatggccgcagctactaccacatcgtccaagccttcgccccggacgatccgctggattttgatacagcgcatgagatcgggttgaagtttgcggaatacttcaagggctaccagtgcgtggtggtcacgcatatgaatacagcgcacatccacaatcacatcatcatgaactcggtaaattttgaaaccggtcagaagtttcatcagagcgccagggagatgcagcaggcaaaggagtacagcaaccaactctgccgggagtatggcttgtccttcaccgagagcaaggcggatccgttccgtattcctgcttggaagaaacggctgtgccgtaccattaaggaagctatggagaactgtgctacccgtaaggagttcatcgcattcatggcggagtacggctacaaggtgcgatgggagccgaatcaaaaatacatcacctacaccacaccggagaatgtccgatgcagagacaataagctcttcgaccagacgcttctgcgcagcagcatggaagcctacttcgatatgggcggctgtgagtatctggaaagccgcatcgatgccaccgagtacggtgaactcctgcctacggtggacgatgccgtctgcggtttgatctccattctggatgcgatgaacaccggcgacaatgaccgcttccatctggaaacactgcatcacagcaagcaggagatccggcgtattctggaacgcggcggcaagatcgaccgcacggtggaatacgctgtagataatgaagaggaacaatacgagcagtaccacgggttttctatgcggatgtaatgacgaacaattccaaagttctgatagctatttccgcaaaagtgtggtagttgtttgtgttgcaaaaagaaaacgaattcaaaggaagtgaaatgcatggcaaaacgaagaccggccggcgacggcatggtgcgaaggcgtgacgacggccgctgggagggccgcatcgtcatcggccacaaggaaaatggcgaaccgctgttccgtcacatctacgccaagacgcaaaaggcgctgctggacaaactccatcagaacatcgagtgctaccgtgatgtggagctgaccgaggacagccgcatgacgctgagccagtggctggatcgctggctcacagagtacaaggcgggtacggtgcgccccggtaccctcgagggctaccgccgctacatcgaatactacatcaagccgcagctgggcgacaagcagatctccctcctctcccagcaggacatccagcggatgtaccgccgcctgaaaacggaggggcgcatccacgagcatcccgagatggggcatcagctctccgactccatggtgcgccacatccactccacgcttcacgccgcactgaaagacgcggtgcaggcgcatgtcattcccagaaatcccaccgaaggtacaacggcgcccaaacccaactacaagcccaagcgcatcctgaccggcgaggagctggatgccttccgcgcggtggtggagcgggacgaggtgtggcgggacttcttccagacggagctgatgaccggcctgcgccgcggcgagatctgcggcctacaatggagcgacttcgatgggaataccggtacgctgaaggtgggccgcactctccacagccagcggaagggcgagtataccgtcggtgagacaaagaccaatcaaggtatgcgtaccatcattctgccgcacagcgtggtggacatcctgcggcggcgaaaagcggatgccatcagccaatggatattccctgatccggtgaagccggaagatcccgtcgatcccaacgcggcgtatcgccacatgaagacgctgctccagcggacggggctgcccagtattcgcttccacgatctgcgccacaccttcgccacccatgccctcaccagcggcgtggacgccaagacactgtccggtatcctgggccacaccaacgcctccttcacgctggatacctacacccatgtcacctcagatatgcaaaagcaggcttgcggcatcgtaggcggcttcatggaggatattttcggaaaggagttgaaaccgtggcaagaaaacgaaaagccggagacggaacagtaaggcagcgcaaggacggtcggtgggaaggccgcatcgtcatcggctatgacgataacggctatcccaagacgaaaaatgtccttgccaaaacgaagaaggaatgcgtcgagaagctccagaagctcaaggtggattgcggcgggctgaagcccgaaaaagtacggtctgagatgcccttcggggactggctgacatactggtatgagaatcactccaagcctaagatccgcccaactacgcaggagacctacgagagccgcatccgcctgcatatcattccggagattggggacatcccgctgaataagctgacgcagaacgacctgcagcagttctacggtcggctcaagaaaagtggccggaagcgcttcaccgacaagtacggcgaagggctgtccgaccgaatggtgcgtatgtgccacgccacctgccgctcggcgctggagaaagcggtgcaggatgggctgatccgtgtgaacccggccctcggctgcaagctgccgccgaagaaggcgagggagatgcaggtgctgacgcgggaggagttgcaacggtttctcatccaagcgaagtttgagggctactatgaagtgttcctcctggacttagccaccggcctgcgccggggtgagctgatggcgctgcaatgggacgacctgaacttcaaaaccggtgtgttgaatgtgaataagcaggtctacgatgtgcgtggccagcttcagatcagcacgcccaagacgaagaactccgtccgcaagatcgtcctgccgcctgctgtggtggcggtgctgcgggagtacaaaaagacggtgaactcccgctggatgttcccgtcgccggtgaaggaggactgtcccatcacgcccggcgtggtgcggcgcaggttgcagctcatcctggaacacgctgggtgcaagcatgtacgctttcatgatctgcgccatacgttcgcgaccttggcgctggagaacggcatggatgtgaaaacgctctccgctatgctgggtcatgtgtcggcggccaccacgctggacatctacacccacatcaccgacgatatgcggctcacggctgccgccaacattgaccgtggcatcggcaaagcagcgccgcaggaggacgcttcagagtcgggggaggaaactgccccggcccaggcggaaaagccgagtatgaccgattttaagccctacgtgggccgcaagcgcaggtccggcaccggctgcgtcagcgagatcaacgaccacctcttcgagggacgctattcccccaaatggcccgacggcaagaaacacgcccgcaacatctacgcccgtacccgcgaggaatgtgaagagaagttgaaggtgttgatcgtggagatgaaaacggaaattgcggaagcacagcggctgagggatatagacgaaggtaatggaagtccgccagaagagcagaaaaagcggggaaagaagacataaaaaacaccggtaagagtgtgaagtgattggtacactatttactttacaacacaatgtctcaaattctacaccgcaataaaacaatgatagagaactgtttatgattctggttatgaatacgacctaactgataaacaagtgccctaacacacttgattgtgtgttagggcacttcggaaataatggggggacgctggtttcagctcggcatgagcaaagagcgtattccgcaaccactttggttgcggaatatgactgtgaattggtatttcatgtatgacagaattacagaaaattatatccccagtttatcaaagaggattctattgcgcttctttgcgtcatttataattttgtcataagataagatttcgatatatgcattcatcttatcattatacttataatacccaagtttatcaggtgtttgtgaaaaatcgtggaaatccaaaatctgctctaatgtggttgtgatgtcacacacggcatataagtagaatttggtgttttgtccgactctgattacacgtccatctttatccctttttttgttgctcctcaactgtgaaacatattcatataactgattgacaggattattactgctattatagtcatctcgcatcggacgtttgagttcaaacaagacaatattctcgtattctcgaccgtcattttcttcatcagaaacagcgactggagaatccaagatcattatgtctgttcggtcttctttcggattgttattaaacggaatatcggaggaaatataactgcaataggcgagcttctcatccagcaaccacaaattatgattgctataaggagtatccgcagaggttgttctcattggataaatgatattatggagaaaactctctttttgaaaatgcccatcatcattttgacgtattgcaaactccatcaagtcgaggataaccttgcggtgagcaacatattcggctaatgcggccccattagcgctatttattttttcgatttgcaatccaaatttctgtatgtactcgtctgaactgattacacctttattcagttcatcgagaagctgagtattttctttggctgttgttctatcgaactctctttttatacgatgtagttcatcatccaatttatcctcacttaaattaggcttgattttcgcaattgcctcaggtgtgtacttcaacagatgacgaaactgtggggcccgatgcgttacataatctgttattcttcgaattttttctgtggcaataggctgaaggtagtctttaagaaattcatttacttcgacgacaaccgctcgcatgatctgatccatagtaatcatgtttgccatgctatctaatgggccaccgtcaggaatgttaaaggaaagcctgttcatatcaacggcctcatcgaggtaatgccctctcaaaacaccaacataccagaatccactttttcgaagatttgtcgatcaagatcggtaatatacttatccagttcttttgtttctactaagcggttatgtgcacacaaatataatttgttgccgttgatagtggactcttcggcttttacatggagcaactcaaaggtttcatcattcaagacaatagtcttgctgttagcttcagatcgaattttctccttaaatatatgatttaagttatgagtttcatcaatatcctgcaggatgatttggggacaatcatcagaaatgaaatatacaagacaatgctggattatccgcatagcaatggtaatactgcgtttaggaacattatcggcatacggtttaatgtaattgagcaatctgactgtcgtttgattatcattatacccggtgcagtcggtgagggtatcattgatgccagaattagaaatggagaaatcaaaggatcgttttacatattcatcttcctcggaatagacactctctatctcagctttttcgaatgcaatcagccaagaaaaccgtccgacacccttgccgccaatttgggatttgtatgttgagtccgattccataaacgaagcaatatttgcttcattgaatccaattccattatcaataatttcgaaggactgaatttggggcaattcaccagtgccatcgagtacaaactgtccatcacgaagaattctgataattatttggccttcaaaagatggatcggtggatttccgctcaccaatggcatgaattgcattcacgatagcctcaaaaagcggcacaagtggctgatttttaggaagattaaagttttttacgcgaccgcgtatattgattgaaaacggtctcatatggtagcaacctccttgctgatagaattgctttgattggttacttggacgagtatcataggaaagcgccctatgtcatttacagtttccatcattaaagttttccaaatcgagtgccgtgcggctttttggccgctttacactcgaattgttgcttgacataaaataactcctcttttggaatcaaaaaagaccaaaagaggagttgaatacaaatataaaaagcaacagcttaaaatgatcgtatgggggactcgaacccccgtctacctcttagtcaaggaggcgctctatccaactaagctaatacggctaattggaatattaaaattataacacagtcaaattaatactgcaagagggaaaaatgtttgatggaaggcttttgtgtgggatggacttctgtatattaaaagtgcttccgacaggatttactaccgaaagcggacggttttgctgtagagagtaactcagaaattgcgccgcaatagacaaagaataagaaaatccctctgaaatcaacgatttcagagggattttggtccgagtagtgcggctcgaacgcacggtctcctggtcccaaaccaggcgcgataccaacttcgctatacccggatattcacttttctgtcatgataccacggcgagcggtaaaaataaagttttttctgtctgtggtcattcctgtggtcaaagccgcttttatgccgttttcaacgactgggggaaatcccacaaatgcaggtgtcacaaggctttccggcgtttcgccttgctccgtcccggataccgccacggcacacccaaagagttgaagaaaagttttttgtataatttcggtttattttctgacgtttctgctctggtttatttgctttccgtcactctttagaggtgctgtttccatgtgttccacaccacactgtggctaaaactgtggtcaaaacaccccccatgccttttacaagtaccgcatggaaacgataaagggcagggatgtttgcgttttcagatgtccacattggcgcctcatattcagagcactcggctccattttgcctcaacccacgaatcagaatttgcggaacataaaacaaaaacgatcggaactgcctcaagtatgaaaaagacgtcccacatagctggtcatggggaaacaggcatggtataatgacggtgaaaatccacatacccagaggtgagctcatgtaccgcatcgccgtttgcgaagatgacccgcgcaccgcggagcaaaataaaacagccgcctgtcatgtgctggagggaaaaggacgttcccagggacgggactatgacgtggaggtattccacaccgccgcgccgctgatgaagcggctgaccgcggacccggacgcctatcagctcctgctgctggacattcagctggacggggataatggtgtggagctggcccgcttcctgcgggaacataaggtcagcgcctccatcatctacatcacagaccaccccggtttcgcgctggacagcttccccacctacccgctggaatacctgctcaagccggtggacgaggggcggctggctgctgccctggactgggactggcagcggcggcaggaccggaaaaagcgcccggtgctgcgtgtgggcggtcggaccgtccccctggacgagatcgcctatctggagaccgccgggcgaaagaccgcggtccataccagagaggagcggatcgaatacaccgttcctctctccaaattaaaagaggaattccagaagcagggcttttgcctgagccatttcagctatctggtcaatctggcccatgtggcgcgggtagagcgggacgcccttaccctggacacaggggaagccatccccgtcagccgccggtattaccaagacttcatggcccgctatgtggaatccctgaaatagaaactccgctgcttcctgttggaaacagcggagtttttctatgcttccgttttggggagcagcagagcggtgctggcggaaaaggagtcttcgatggctttcaggaccaactcactgtgatacttccgggcggtggcccgtgcggacttgagtcccataccgtggagtgtgccgggcttggttgagttatatagcccctcttccgggtcgaagttcaccggggcgaaccgggcgttttctactcccacatacaggtattcaccccggaggtgcatggtcacccggagccacttctccgccccctcggggctttttcgttggcttccagcgcgttttccagcaggttcatcagcagggggcaaaggtcgctgttgggtatgtggagttcaggcggcagctccacccgtacctcggcgcggacgcctgtctccgcgccccgggccagcatggctgtcagaacggtgtccaccgccgggtggacggtgtagccattgcttcggttcagctcgggccgctgggacagggactccagatacttctggatctcccccatatctccctcccggcacaggccctggagggcggtgacatgatgccgcaggtcgtggcgaagagtctggatctcctcattgtgcttccgaagattttcatagttttcccgaatcagttccccacgttgaaggagaagccgctcctcggtgcggcgctgggattcccgccggaacaggtcaatgaaggcggccaggatgccggcagccatggtcagtgcggaccacgaccacagcaggaagcggggcaggccattttggaagccggtccggagatgaatcatcagctcacgcccccatgtgggatcggccgcagcatggacaccgcatacagccagccccattcccaggaccgccaggagcaacggggagaacagccagtagaagccgttcccccgctttctccaaaccagggagaggaccgcagcggccagcaggcccagaagccccagatactccgataccactgtcagcagagaagtggcagaggcccggcccagcagtgcggtcagaccgtggagagccgctgtcccccacagaatccagcgcagccgcccgttgccccggctccccagaaagagcagcagagaggtcaggcacagggcgcggctcagagcgttcagatccacttccgggtatgggagatagtgaccgaaaaagctggcggcccccagagggaccagcatgaggaaaaaggcggccaaagagaatatgaaaaggccaatgtcccaacgaccccggaagctctgccacaaaaacgcagtggagagcagaagccccagcacaaagcagagggccgcagggatggcagtccggaagctctctgccacgatgccgctctcataggcatatccgcagctcagcgtcaccgtgcaggggtaaacggtaggctccatctccgggatctgcttttcccccaggccggtggactgggcaatggtcagggttttacccagatagtccgggggcagggtgatctccaccggctccagccggtcccagcccagcatgggcagcgtcagctctcccaccccgccggattgctccggacagtccgtgtagaggcgctccccatccaggaacaccgccacgctgcggttgaccgtgtccagatataaaacggggctttccacctcctcggtcaaaatccgggaaaagtaaaaggtctgccccggcgcggaaagacccgtgtagccgatgtccccatcgggcagcaggtctgttcgctgttgcccctcctggatatagacctcccactggacggtttctacggacaggtcaaaggtctgttccgtcatgggctgggtaaagaacagcagcgccgcagcgaaaaatccgcacaggagcagaaccataaacgccgccgcgccccgtatgatccaacgtctcattcagcccgccctcccatctaacgtgtttcctattctaagagtaacggggaatcttccttccgtcaagggtacgggcttaccaagtttgcaggaaaattgaccatgtttgcaatccctattgaaacagcaaaatgtttcggtatagtgataggcgtaaggaactgtgcaccggactaaaggactggcgtacagagaagaattgcaagggggtcacccccttgcacgggatgaggaccatcccgtgcaaagatcctcctgcaaagcgaagggagagtttctatgagaaagaactggaaacgatggatcgcggggctgctcactgccgtgatgctggtcaccatgctgcccacggtggcctatgccgcagttggcgacctgctggacatgagcggtgtgcagcgcaccgccctgctggctgcgctggaggaggtctacggcgacgacgccgaggcgtatctggccattttgaagcagtatggcctgatcgacgaggacggcaacatcgtcaccgacgagaagatcatcatggacgggcaggcatacaccctggatgagatcgaggctatcctggacgacccggccaccgaccttaccaaagtggtggaggtggacggcgactatctcaccctggccgacctcaagaccgtcgtggagatcgagcggtatctggcctatctcaaggccacctacttcaccgagcaggacctgaccgacgagcagatcgacaacttctacgacttggcggaggcctgggccaacggggatatggtgatgctggccgccgatgccctggagggcgtgggccccgccggggtggaccacgacgtgcggctgaccgtcactggggcggccaccgccgaagaaaacggcgagtataccgtcaccgtggaggcctcccggtccgccgcagatcaggagatcaccttctcctggcggacagtggacggcagcgtgaccgccgacattgacggcgaggagaccgttaccatgtaccccggcgagagcaagaccctgaccgtccatgtgggcgagaccccagagcgcgtccagggcacgggaaccttcctggtgcagctctatgacctgaaaaacgcccttctctctgacggctccacccgctgggagcagaccgtgacggtagatagcgacgactatttcaaatactattcccgtgtctcgaaaacgctcagctatgagagacgagagcatggtgttgagactgattgggtcgtcgcaggcggagatgaggaaatgcgggaccggatccgggatggcggcaaccccatgtttcttgcggataaagaaacgctttctcttgaagggatgtcctccggaaactatttacgcatatttgaaagcggcggcggtagtttgattgccggcaattttcagtacacagttggtgctttagggtggttttttgaccccggttcctcgcgcccgatcgccgaggagcggccattctcctatgaattaaagatcgatgatgaagtgctccaggcggacgacaactttactgattgggtcgtagaagagacttacttgcttccttctatcgggttagaggctttccccacacaaagcgaaaatctggattatgaggagggtgatgagatccccgagcacacgatggaaatgaatatgtccggatattaccgccggtatcagaccagcagtggcagcgaaacctcattcgcttttgatccatacctcgaatatcgcgcatcctactacatgcaggagaccaccaaggagaccaccgtctctttctccgccccggcgggcacctactacgccggacagcaggtgcccatcgtggctaccttcgattaccccgtgaagatcaccgaggacatgaccatcacggtgaacgacgatcaaacactgaccccagaggaggtggaaaccaccggcgagagctgcaccttcctctatcccgtgaccgagaccagcggcggggccatctccgtcactgccgccaacttcgtgggggatgaacccacctgccagctggagggcgccaacaagctggagttgaccatctcccgggggaccgacgacctgaccggcgtgacactggaatctctggaccgggaactggcctttggggcgcccacgctggcggtgcgccaggagcagcaggggcagaagcccgtgctgaccatcaccctgcccctgactggaaagccctatgacaactgggtgttgaatgaggtgacggacctgaccaccggcatcctgcccgccctcaaggcagtgctcagccagacgggggacacccagtatgacttccgggtgaacgacccccaaaaccccacggcgctggtggcggagatcaccctgccctataatacctctgtggaggagttcaccggtcaggtggacttcctgctggacggctatgtgatgatcggctggggtcgggagtacaccctggacggctccaagccggtgggtgcctttgacggcggcatcaagcttacccgcacgaacagcaagactggagagcgcgaggaacagacaagcggcacagtctattttgacttggcggaaatggcggattgggagatgacgctgtccttcaccctgaaggaaggcgacttcacctggggcgacgtcactaaggtcaccgcgtacccggaggacaacaagccggaggggatcgacaatcaatttcactttgcatgggaatactccggccccgtcacggtagtactcaacgaggacggcagcaccagctttatgctcaccggggaaacaggatatgccaatgccagactggtggccctcaacggcgatatggaggatgcgctgcttggaagcgtcaccctccattgtgaaaactggggaggcgggacagggaacgcttttctccagattcccgaaagcggcagaaacatctccgtccgtgaggggaatgacgcccggatctactggagcagcaacatttgcgccctgaaccagaacgctggggaggacggagcctttgttcccaccaccttcacagtgcagctgggtacgctcaatttagaggatgcagatccaacggtagcggttgtcaaggagtggacggtgacgaccgatgagaagaaccccatcctctccgcctttaccattccgtgggatgaagggctggatacattctacaatgaggaaagaacggggctgatcgttgcctgtatctctgcggaatatcaggaaaagcggctcggcacctatatcaacgagaatggtgtaccggagatgggggagggcgaggagcctgccattgcctacatcacgctgctctcaccgcccgcgtccgtcaaactggaccagcccgcaggcggcctgtaccagaccgatggcggcgggaacggcaaggacatcactctcagctggacggcagacaacctggatgtaaagaacggcggcggacagtttgaactgtacatcgccggtggcgaaaagaccatctcggaaaccgacctgacgggcggggtgacgcaggatggaaatacctattcctacaccctgaatgtccctgctgtgacgccggagaccggcgaccccgccagctaccgggacgcctataccgtcaccgttaaggtccagaacgccgccgacgccgcctgggcctatgacagctatgtgctctatgtctactcggaggacatcctggagatcctgctggaccacgacgagaacaccggcggcagctacaccatgtccaacgtggaaaaaatcaagaccctgtggggcgacggcggagagaacggctccaacgccatcgtggccctccagcgggacatcgccctgagaaacgtcatctccatcaactacggccagtatgcctgggcggagctggctgaccagatcgcctgggcctccaacgacagctcggtggcctccgtcaactaccggcagggcactctgtatgagaacatcgagaacttctcctacaccacctaccgcccctccaccgacttcgtcctctccggcctgaaggacggcgaaaccaccgtcaccgccacccacggcaagctgccggagatctcggacagcctgacggtggatgtggaaaccttgcgggatcagctctacctgttccagtgctaccccaagacggagaccaccctgacctatcaggtgtacaccagcgccgccaaaaccgccaccgaggaatacaccctgaccaccaacgacaaaggcgaggctgccatctatgcgccccacggcatcgccggggacatctactgcaattccgtggcggatgatggggatgacgaggacgttatcttcctgggcgtcatccgcagccagagcctggtgtcctccgaggccgactccaccaagctgcagctctacccggtgaacaccctccagctgcgccgggcggcccaggcggaaatttatctaaaaaactcggacggcacgccctatgaggggcaggtcaccttccggggcggcgtgtaccggggcggcgagtactgcacgggcgacagaaattctgcggtgcagtttggcctgcagggtgagaaggatccaagccagtggaagcccggcaacacacctcaaacggtcagcaccaatgacgagggccgcctgctggtgaacatggatcttggaaagttcaagaccgctgacaaccagaaggaggtccaggcgggcgaggcgctctactacctgttccagctggagtacggcgacgggactggtgcggaatattatccaatcatgctgcgggtggacgccaacctgaacctggacgatgtggcgatctccggcgacagcatcgtggcctgggagaagaatgagagcgggcagaagcagccctatatcgcccagcagaccctgagctacagccccaagaaatacgccagcgtggccgacatccgcgggaacaccggcaacgtgggccccagtgataccttccccaccgcctatgtcaccacctccatcatgtggtggggcgacgagcacgccaaggacctggggcgggctaacaccgtgatgctccaggacgccaccggcaagaccccggaatgtcagaccagcgagacaaccacatatcccttcacggatctggccttcaccgagaaccggatgaccatggacaaggatagcatggaggagtggggcatggccgcgggcgagagccgcgggatgcgggccgtcctcagcgaggacgggaccaccgccagccgcaccatcagcctgcccttccagatggtcaatatgatcggcgtaccggaggcggaggcctccaatgccctgaccggagccctggccgacgtcaagagcggaatgaccgtggatgccagcggagacgttggtgatatgggtgacggcgatatcatgatcgagggcggcatggatctgctcagtgacgatgccggctacgaccccgagaaggacaagttcgccgtgcgcctgtacgccaccagcgaccccaccgtgttccgcgccctgttcggcgtgaacatgggcgatctggagcccggcgtctatcccgagtatgacgacccggacaacatgaccttcgtccacggggacgcctccaccggcaagaaccaggagctggaagcccttcccggccccatggacgtctacagcatggtcaagggcaaatacctgagcgccgccaaggaggaggcccagcaggccgccgccggaaagggcctcatggggaccagcatggcgctgggcggctacatggaggcgaatatctcctacaacagcagcagcggcaagtgggagtgccagcccatcagcggcggctttaacgtaggcgctggcctgaacttcaactggaacttcaacgccgtcgtgggcatcgttcccatcaccgccagcgtcaacctgggcggcgcgctggaggtccgcatggacatgcagcagggtaactattacgaggtgacctccggcatggacggtctgaagaacgccggcgaccagagcgccttcaacaccgccctggccagtgccagttataccgacgccaccggtagcgattatcttaccaacctgcggatgtacttctatatcagagccttcgcgggcgtgggcttcgacgtctcagtggtggcctttaagatcggtgtgttcggccagctgaatttggatatgcagtacaaatggctcaaccgcggttatctggaggaaagctcgaatatcagcgccgtggggccggtcagcagccggacggacgacgttatacagggctccaacctgtctgtcagcggctccaccggcattgagttcgtattcaaattcctgttcatcagctatgaaaagatcttctgctccatcggctttgagtcggagtccgatgatccggggtggaggaccatcgaggagatctggaaagccaataagaccatcaacggcaagcccgtcacccgtatggccatgcccaacggccaggtgatatacgccgtggacctgggggcgcaactggaacgccgggactatgtggacaccgccgagcaggagtggctgggcggacggccctccatcgggctgttcagcctggacaaggatcagaacgccacactggcggagaccctccagatcggggcctactcctacgccaacccggtgctgtccgacgacggtgaagtcatgttctatctcagcgaccgggaggacaacgacccggagagtgcgttggacatccgcaacactcgtgtggccgtgtccactaagagcaatggtcaattccagcagggagagcgcttcgacagcaatgatgaagtgtccaccggctacggcgacagcaatgtgaaggtggccggctctgacggcagttacgccgccgtgtgggtccggcagacagaggacatcaccgaaaatgtggtccccggaactgccctggacgatggtcagcagatgctccagataaattccaccgagatcatggccgccacttccacgggcggcagcgactggacgctggagcagctcaccgacaacagcacccccgacctggcccccgtggtggccgccagcggcaatcgcatcattgtggcatggcgtgaggtcaaatcctccgacgcctccaatctgaccaactttgaccagcaggacgccatccggtatgccgtctgcgagaacggccagtggatacgggatgaagatgtgttcgggaatgaatacgtcgccgcccagaccctgtatgacggcaccggctccacggcctctgtcaagggcctggagatggccatgctggaggacggtaccgccgctgtggtctataccctggataccaattccaccaccgagaacaccaccgactgggagaccgttgtggccattatccccgccgtggacggaacatacggtgcggatgatacccagagcgaagacctggtgcgcaccttccgcctgacttctgacaacaatctggacgaaaatccccagatcactactgcggagtttggggacggcgaggagcggttcgtggtggcctggcacactgagcgagccatcaccgacgacccgaacggcgagactgagtccgatatccggctgtccgttatggacacggacggcaaactttatgagaatatgcccgagtccctgagcgtggctgccggcggtgccggcgacacaatcggctccaacttccgcttcgcaaagaacacccaggacatcggcgacctcgccatcctgtgggtggactctgtcagcggcgagaccgacgagaccacttacgactcccttgcaggtgcggtatctgccagctccactaacgtgggccacgatgtgctcaaggcggtcaagttcgtggaggacggcgattcctacaccctgtccggcactgtggaagttgcggagatgcaggagggcaccctcatcgaccacttcgacgcttatgtcaacgatacgagcacgtacgagatcaggtcagtcatcctgggtactaattacagtgagactacagagcgtgaggtgactatttccgacggtgagaacgatgagactgcgaccatcactgtggccaaccccgtcagcggaatgtataccgccacggagaagttcaccaaccagatccaggagtcggcggtgatgctggcatatgaggagctctacaccaacagcgacatcgacgtccagttcaccatccgcaacaccggcatggacgccattaccaagctggagatcatctcggaaaatgagagcgtctataccagcggcgacacttctctgaacctgatgcccaaccgggacgtcaccgtgacggccaagttccccacgggggaggccattgagaacgcgaattacaccatcaaggcaaccttcaagaatggtgtgaccgtggaactgcccggcactctctatctggacatccccgacgtgggtatctccaaagtggagaccgtcaaacaggccgacggcgtacgcaccctgcgctatgccctgcacaaccgcctggccgccagccttgcagacgagaaggataactggcaggtcaaggtgggcttctacgccgaccagagctgcaccacgattctgaagggcaccgatgggcaggatctgatcgataccatcacggagacggcagatctgtccctcatcgacgccggcggttacagcgcggaggtcacgctgcctgtagcagagtacatgaaggaggaaagcggcgcacaggcggagatccccagcaccggtatcccggtctatgtcaaggcctggatcgaagcccctgtggaggatcaggccatgcgggcccgaaccggttcctacaacagcgtcagcgagtatttcaccgccaacaacaccacctctctgactctgagaagcctggctgaggagcgggatgagccggtcaccgtcatctacgacatgagcgttgccaacggcaagaccattgtgaatacaaaggtgcagtacaattacctcggcggcaccaccagcggcaacctgatcgtcacgctactggacgcccagggccagcccatcgccaagcagcagagctacaccaaggcagacggtttgctgacgctggaaaaagagggtgccgcaacccagacctttgagttcgcgggcatcaccggtgctgccggcgtccgggtggagttctccgacctgattctgacggacagtagcgtggaactggaccatatctccatcggcggccacaccgctgtcttcgactcgagcacaaacacctatacggtcgatgctgtcggcctgaccaacagtatcctggagatcgcgcccaaggacccccagaacgcaacgatcaagctggacggtcaggattatgatgtggatgcctcgcatgccacccagcttgcctccggtactaccacatggaacattacagtctccaacggcggcaactccgcaagctacacgctgaagctgaccaacaatgccgattttgtttctgtcaccggagtgagcctgaacaagaccagcctgaccctgacggagggcagcacgagccagctgacagcaactgttgagccaaacaatgccacgaacaggaatgttacttggtcttccagcaattccaaggtagctacggtggacggaaacggaaaagtcactgcccacaaagcgggcaccgcgaccatcaccgtcaccaccgcagacggcgataaaaccgctgagtgtaaggtcacggtcgaggccggaggtgcgccggctgtcaaagtcgacagcgtgagtctgaaccaaaccagcatgaacctgacggcaggcagcacgggccagctgaaagccactattagccccagcaacgccaccaatcagaacgttacctggtcttccggcaatacctccgtagccacagtggatgccagcggcaatgtcaaagccatccaggcaggcaccacgaccatcaccgtcaccacagaggatggcaacaagaccgccacctgtgcggtcacagttactgcagcacctatcaatcctgaccacggcggatctgggagcggcagcagtggtttgcccagctatgtagtggataccgctgctgatatcgaccatggcacgatcacagtaaagccaagtcgtgcggaaaagggcgacacggtcaccatcaccgccaagcccgacaagggctatcaggtggacaaggtcaccgtcaccgacaagaacggcgacacggtcaaggtcaccgacaggggcgatggcaagtacaccttcaccatgcccaacagcaaggtgagcgtggatgtgacctttgtacccgaaaagcagtggacaaatccctttgtggatgtggcggaggacgcctggtactatgacgcggtgcggtatgtcaacgagaacagcctcatggccggcaccagtgccagcaccttcgaaccggatctgaccaccacccgcggcatgatcgtgacgatcctctaccggctggagggctcccccaatatcgaaaatgagatctggggctatcccttcaaggacgtggatgtcaatgcttactacgccacggcggtctactgggcgaggatgaacggtatcgtggctggatacagcgacgagctgttcggccccaatgacaccatcacccgtgaacagatggcggccatcctgtaccgctacgcccagtacaagggctgcgacaccacagccaaggcggacctgagcaagttcgcagacgccgcacaggtcggctcctacgcggtggaggccatccgctgggccaacgcagagggcctggtctccggcaccagcgataccactttgacgcccggcggctccgccacccgggcgcaggcggcggtgatcctgacccggttctgccagaatatcgtaaagtaacccgcgcaggaattgcgccgtataaacaatgaaaaggcaggcaggagagcgagctctcctgcctgccttttttctgagggtgatagtttgaaatcccctaaactgtccgcatgccttatcaccactgatccctctgaaccccgcttagatccggctgtgcattttacgattcacaggaatagtgaatcggcaaaatcactcactcaaggtatgttcttctgtgcagaactctaaattttgttttcgagcctgctcactcctctgttttgttgcctgtatattatgagggcgtattatttgttcctattttcatttgtgaagtggcctacttattgcctgtatatagtgagaggctttttgcttctcacacttaaggaggtgttggccatgaaagaatcaggctacaaaagctatgaggacttgccgctgttcctgaacgcggcaacagtggcaaaggtgctgggggtgtctccctcatccggctacgagctgatgctcgtcgtcgcaaagtccactccgctccacccggcatatatgccgggtatacgctctgctcccttgctcctcctctccccatgaaaacgcattgcgttttcatgggggcctcttatggtttcccggtgctgaagatcggcagccggatggtggtgccgaaagaacagttcatctgctgggtggaggagcatacgggaggcggcacatgaagtatgggatcggaaactatttctctcttccaaacgagatcttcctgctgggtctgagcagcggcgagctggcggtctacagtttcctgaaacggtgcgaaaatcgaaagacgcatcaatgctggcccagctacaggaccatcgggcaggcagtgcgtatgagcgagaacacggtacgcaagtacacactgtgccttgaggagcgcgggctcatctccaccgagccaactgaaatcaccaccagggctggtcagaaacgcaatgggaacctgctgtacacgctccgtccgatccaggaggtgatagatgaacactacgaccggcaactggatcagctggagctcgttgcggcgcgtcagcggacgacagcggcccaggccggcacgtgaccgcctgtgggccgctgtgtgcggcgattgcggcatgggcaggaacagacactcccgcaccacaaagcgcggtgtggggggctgtgtgccgcaggtaccgggatcgcccggaagccaaaatgagcgggtgaaccgaggggacgaaaatcgtgcaggataaaggccgggggtcgcaagcgccctccggccgggtcacaccgccccgcaacgcgggacgggacagtggtttgcggggagttgcctgcgggggtcataggtggtcggtttggctcacttcgggggtcacaggtggccggaatcagaggattgcgccctcaaatccgcatgaaatcagggttgtaagggtgaacccgcgggggcaccttggggatatcggttggttttatcgcaaatccaagaagtgaatattcggactattgccccttcaaaaattgcgctgcaaaacaaagagaaaagcctcccgctgctacgggaggccaggcatttacagcatatgaaattcgattccttgatgtttcggcgtatcatttggggagagtttcatgacgcgcgcccaagtcttgaccgtctgcgcttccaagaaacggaccaaagcatccagagactcctgttcatcatactgctggagcgcctcatagtatgcctttttatcttcctcataaatgatcatggggggatagtcgttgatcatcagccagtagttcaataatgtccgcccaacgcggccgttcccgtcggcgaaggggtgaatattctcaaaacgcgcatggagatacgctccggccttcagcggggctttcggacctacagagttgacttcaccgatcagttctgccaagtcaccttccacttcttcagggtaggagccgacctcatggatgccagtcacatagtcatgttttttgaatgtcccgggccgctctccattgaccagataacggcgcgcatcgtaagttccctccgtcagcgcgcgatggatctccaggatcagtgggagggaaagcggctccttaacaggaatcttctcccggaggaagtcatagcagaccttctgattttgaagttcaaacagcgtgcggggatcgccggtatagccgaccacccggccgttctcaaaaatctcccgggtgtcgtggtaagaaatcgctgcgttttcgatcttcccggagttgtacgcgaagagaatgcggaagttgtccaggcgcaggtccaagtcttcgcctgaacggacagcccacatttgccactgttttttcacctgatcgtatagatccatgcggccacctccgctactttatgaagacagtataccatatattttggtttatcacaaaaaaatttttgattgccactgtgttcgctaccccaaatgataactttttgataacagttcgccgtacccctggatagttttctctttctgcggtatgttgtgtcgttacaaaggaggtgtatcatcgtggcaaagcgcaggccatccggcgacggcatggttcggaagaaggaagacggccgttgggagggccgcatcgtggtaggccacaaggccaacggcgcccccatcttccggtatgtgtatggccgcacgcagaaggagttactgagcaaactccaccagagcatcgaaacctatcaggatgtagaactgaccgaggacagccgcatgacattgggagagtggctggaccgctggctggatgaatacaaagcggggacgatccgccacagcaccatgtacggctaccggcagtatgccagactttacatcaagcccatcctgggagacaaggtgatctcccgcatcacctcgacggacatccagcggatgtacacaaaactgaaacgggagggtcgcatccatgagcatccagaatacgggtatcaactctcagacgccatgctctcccgcatccatgccatgctccaccaagcgatgaaagacgcggtgggcgcacacttaatcgccaagaatcccaccgagggcacggtggtccccaagcccaactaccgtccaaagcagattctgaatgaggaacaattggacactttcatggccgcaatcgagcaggacgaggtgtggcgggacttcttcttcaccgagttgaccactggcttgcgccggggcgagatctgcggccttcgatgggaggacttcgacgaggcggagggaactctcaaagtcaaccgctccgtcagcacccgcaaggcaggcagcctggaggtcggagaaaccaaaaccaacaagggccaccggagcatatccctgccggacagcacggcccagcggctacgggagcggaagaaaactgccatcagcgattggatatttcccaatcccttgcatccggaggaagcagtcaatcctggttatgcctacaatcggatgaaaacgatcctgaaaaataccggcctaccaagtattaggtttcatgatttaaggcacccgtatgtcaagcacacgacaaaaatttttagcttgcgctcgatggcttttcaagcgcaggcttatcctgatgctcggcgaaaaactcgcggagcttgtcagcttcatcggggaggacaaagccaaagccctgtccgtccactctgcaatagaaagcgattttcatgactgccacctcaatcaaaaatgtcctggattttgtatgcgatctcgatgcgcttatcgggatataccagcacccggtcgatcaacagctcggccagctcggtggtcagcgtgtccgcatcgaaaatcgccttggacgcttccttgcggctgtcctgccgtgcctgttcgtcctgcttctgtttcgcctgtgccaatactgcggcataggcgttttttgttttcagcagcagctcgttacacgcggccttttccgccttgtaggtgttaaggtcaatctcgcccataagatagtgttcgtaaagtgtgcgcttgccgtcttgcagcgtctcgatctgctgctcatattcggcgcgttccggtacggaggcatccacccggagcgaaccgtccggggcaaacggtgcggcggcttccatctgctttttcagcgtcaggaataccgcttgttccagctctgcggcgttcagacgcatcttgtgacagcggctttctacgtccgcctcggaatggcggcagtaataatacgaggttttctgcatggtgcgggacagcgcatgaccgcagcagccacagaaggctttgcctttcagcgggtagtcccgctttttcttgtttggctgggaaaagcggagctggctggcctgcacggtatcaaacacggctttctctacgatggccgggtgatggtcagggatgatgtaccatgattctctgtccttcaggtggcttctggtgccgcctacttcgagaaccgcccgcttgccgatcacatacacgccggtgtagcgttcatcctccaaaatgcggagaatagtggatgtactccaaatcccgtgacagcgggaaatatcatgggtgtgattgccgtgcgcggctttgtactggccgggagtggggatgcttctgcgaaacagctcccgcgtgatggcggtggcgttgatgccctcggcggcaagctggaagatgagctgcacaacggcagcggcctccgggtcaggctccattctgccatcggcgcttttgcggtagccgtaaggacaaatcttgctctgatactcgcctcgctgcatcttggcgtactttgcgctcttggtcttgatggacatatcgcggctgtaatactcactgatgagatacttgaacgccacatccatgccgccggtgtcgcccttgaatttgctgctgtcaaaatcgtcgctgatggaaatgaagcgggtatggaacagtgggaacacacgctcgatgaagtatccagtttcaatgctgttgcgcccgaaacgggaaaaatccttgacaatgatgcagtcgatctgattggcccgcaccagctcaatgagcttctgcacctgcggacgctcaaaatttgtaccgctatatccgttgtcgatgaactccatgatctccgcgttcagagcttccggcatggaagctgcgtactcatggaggacaaggctctgattttcaatactcagactgtcgtacttgtagtcctcaatggagaggcgtatgtagagggcaatcacatatttctgcattgttccagcacctccgcataggtttcaaactcgctctggaagcgatagcgcaccgtgatctgcttattgtgggatacctcaatgcggtcgatcagccgctcaatgagcgcaccggtcagcgcacggtcggtcttgatctgtgcagcatcctgtttcagcgcccggtgctgcttggtttgggcatccattgtccgcagaccgtcctccaactgttccatttccacggcaagatcggcaatgcggctttcgtacttttccttgtagtcgaaatattcatccttggtgagaacgccttgaacaaggttttcatacaggctccgcacgataccgcgaagccgctggatttcctgtttgcggctggtgatcttctcccgcagctcagcgcggtcagcggcctgccggggcagttctgcaagggagagggtgtattgccccagcgccgtatcaagcgcgtcctgaagcatatctgccaacatatccagcaacgcatcctcgcggatggtcacgccggggcaggcatccttgctgattcggctcctgctcagacaatggtagaagtacacatcgtcggacttcttacggatgtttctctgccggtgcaggctgccgccgcaatgggtgcagaacaccttgcctttgagcaaattcggtgtgtatgcgttgatctcccgcgccttggcgcggctggcggtctgattgagaatttcctgcaccgccgcgaactgttcccggctgatgatggcctcatgggtgtcccgcaccaccgtccattcctcggcatcagccttgacctgccggtgatccacggttttggtctgcccctgaacgagatctccggtgtagacctcggagcggagaatgacgccgaccgttcgggtctgccacttgccgctgccgagcaaattttcgtgggtgatctttccctgcatcttcttgtagtggctgggggtgaggatgccagcctcgttcagccgcacggcgatggtattcaggccagcgcccttggaagcccaacgaaacatccgctgcaccacgacggcggcaacggggtcgatgataagctggtggcaatcgtcctcggctttcagatagccgtagggagtacgcgcaccgataaatttgccgtccttcatggcctgccgctgctgcgccctgatcttgcgcccaatgtccaaagcgtaggcttcgtttatcatgttccgcagcgggatgatgataccggaatgggcatcctccggggcggcggtatcgaagttttcattgaccgcaataaagcggatgctgcggatgcggaaatactgctcgatgtaatagccggtgtcgatggtgttccgccccaaacgggagaggtctttcacaatgacgcagttgacgtgaccggcctcaatatccgagagcatctgctgaaagcccggacggtggaagtttgtcccggtcgcgccgttgtcaatgtaggtatcgtacacgctgatctccgggtactgctccagatagcgggcaataatcatctgctgggtttcaatggatacgctgtgcgtgtgggtatcctccaccgaaaggcggacatagatcgcggcgcggcaagcggcgtcagcctcctgcacggccaccgcagccgtttcttttctgcttttccttgccatgctcagcccacctttctctgttcgtaatctttctgctgcgctgccagcgccagaagctgcaacgcctttttgtattcgtcctcatgggtaaaggtaatatccagctccttcttcccacggacgcggatgctctgtaccatgtgaatgagcgccctgcggtctaaggtttccagcgtggagaactgcgtaaactgtgaaatccagcggttgcgctcactccggttttccagcacctccgtgagtttttccttgagaacgcggacgctctcgcggatgtcctcagcctgcttggtgtactttgccttataggaagcgtattcttccttggtaagcataccccccacaagactctcataaagccgtgccttgaactccagcacctgctccaaccggcgctcgttgtcggtgatgtggtcgctgtattccttggcaagcgcctgattgatgctggtctggtcaatgccggtcagcagcgcctccagagaagcaatattgccgatataggctttcaggctgtcccgcacacagtcgatcaggctgctttctttcagcatgaccggatgggcgcagccctttttcttgccggtaggacaataatagtagtggtactccttgccgtttgcacggttggtcttgcgggtcatgcggcttccgcagcacccgcagatcagaataccggagaacaggtacaccgtatcctcgttgggagaagtgcgggtatccagtcccttaatgcgctgcaccagctcaaaatcctgacgggcaatcagcgctttatgggcatccgggacgcgcacccactcggaggcggggcgctgctccatctgcttgatcttgtaatgcggcgtaccctgtttgccctgcaccagcgttccggtgtaggtttcgtcctgcaagatgcggatgatggtggttgccgaccacttgcagtcagccttgtccgcatagccctttttcgcgtagggcagaccgttgttcttcttgtacgccagcggggagagaatacccagccggttcagctctgccgcgatcttggaggcgcttgcgccctccagccgcatacggaagatgtcgcagacaacgcgggcggcgtaggggtcagggacgagcaaattcttgttgtcctcggctttcatgtagccgtacaccgggaacgcgccgacgaaatcgccgttgcgccgcttcacgtccagagaagaacgggtcttgatggaactgtcccggcagtaggcttcgttcataatgttcttgaccgatacggccagatcatcgccgctgtcgtgggcggtgtcgatgctgtcggtgatggcgatgaagcgcaccccataggccgggaatacccggcgcagataccggccggtttcaatgtactcgcgccccagccgggagaggtcttttacaatgacgcagttgatatttccatcggtgacatcctgcatcatttccttgaatgcgggacggtcgaagatgatgccgctgtatccatcgtcgatcttttcggaaacgacctcaatatccgggttgtgctccacaaagttttcaatgagcttgcgctgattggaaacgctgtcactctcgctggaatgatcgtcggtgtaggacaggcggatataagcggtggctttgaatttaggcatgaaaaagcactcctttctcccggactgctcccgcatgaaaatagtggttatctggctattaggttttcatccttttccacaccgatcatagcactctctgcggaaaaaagcgaggatgtcgctcagcgcaaaatgccttgcagacattcctccaacgtaacaccgttcccggcgaagcaggcgtttaccacgaaatcgccgcagcggaagcggtaaggatttttgatctggcgaataaaggcggcaatgcgttcttccttgggaagatttttgtctacggatacttcccggatgtccaccagttcatccgtgtggatttgggtttcgtttggtgtcggctgcatcatggcgatctcctttctcggtttggtgggtttcctcaaggtcacatgaatgcgctgacgggaaaggccatcagcgcatggtatctgactttgagaggcggctgcgcgggcagaattggagccacataacataatggcgaataccggcgcagccgctctgcttgtccatttgagaagatccatcctatttgccacgcgccccggatagtgggcatgatgcaggccgcccttggcagggctgtcataactccacgataccgctgcctcaaagagctggcgcataccgcagggttccccctcaagtctgtgggagggcgtgagcaagtttcattatccgccgcgctgtcatcgcgcccgatttgccgaatcgggtctaaggctgcgtagatcgctcggatggcttttccggaatcacctccttgaagccatcgtcgtggcggcgcaccttatgccgctatcacgcgggttttgtgcctgcatcatggtctattcagttttcaacgttcggtgaaaggcttcgtggagaatgtcccttcacctatcgccgattttgggccacttttgcaccctgttttcagcaatcagggaaaagttttttcattttcttcatcgccgcgccgatgctcttggaaatattctgatggctgacaccctcggctgcgccaatctcatcaaccgtcatcccatccacgaaatacatccacaccctgcggaactgcgtatccgtcaggtgcttccgaatctgcgtgacctttctgacgctgcggtggattgcctctgcccggtcatgcgcctgctccatgcagacatccacggcaggaatggaggccgcttcctcggatagctcatccaacgcaagcgtgtgattggcatagacgtgagcttccttttcggaggcgtgatagtcctcgtccgacagggctttccatttcagaaattctttctcgctggcaaagtcctcgcgggtcaggcggacgatgacttcattggcgtccatataaacgatggcatcggggtctttcttattcagcgcatagatgctttttctattaaacattttgttcctccgttcagatccgagtgggtaaaaaggtctgaacgaagggcggcggggagcggcagcccacggcgaaaaagtgccgggaacgacaaaaagcgcccacacaggcataaaagcctgcatgggcgcttcggtgcggttcagtatggaaattgtcggcggctgtcggagggcataggtatcctacggtgtccgggtatcgtccggctatgctcccggcgcggcttgttgccgcagcattagcggcacctcctgtgctctcctgtcatacgcataggtccctttcatctgaaaaatgttgggacagcaaaaacaacggccgccccgtacagagcagccgccgttttccctataccatacgctgcttttcagtaccgcaaggatgggtgtcctgttatcgtcgtattctgatttcttttagggcatttcaggactatccacaagggatacgctgaactcctgcgcggttgccccctccggcagcagctttgccatgaccaccagccgctgattgccgctgttggccttgtcatacttccggcagcaggtggagagggtcagaacggtatcttcctcggagaaggtcacgccatcaaagtcaagccagtttttccgcgcaatcgtctcaaagaagctggtcagatcatctcccgtgggatcaggcgcaatatagtcaaagccaatatccgtgacgaatagcgcggtgatctggaaaatcatgtcctcgccatccacagagagatagatatacggatgctcctttacaaagtctgcgtccatataacggtagagcttggtgaaccgcacaccgtccgggtcgcagttgctggcggagtgaccgaaaacagtggtgtttttgtccagcttatccctgccgccgatttcgttttcacaatgggcataatagcagccccacatggcatactcaccgttttcatccagcttcaggtaatagccgttgtcctccgcctgcatcacgggatcgtctacctccgcaccggggatatacagccatgccacggtgtcgggattcttcgctctggcttccgccaactctgcctgcctgtccaccgaggggataacttcgcccgcgggagtcgctgatggctgagacgcagatgtgccggaaggcgttctgtcgggaatgtcgataggctccgtccctttctgatagcagcccatgactgccgtggtcatggcaaagagaaggacggccatgcagatgatcggacgaatgattcttgtgattcttttcataatgctgtctccttgccgcgctgggatagcggcgcagctcaaaatgtcattgatttgtttcttgtagcgaaaagagaacagcgcagcttcagggcgagatgcccgtccgctgcgctgtccgatgttcgcttatggggtcatgccagcggctttgatgtttagccgtatgtcagccggtcacttcttgcagcgccagaggaaggtcacgatctgcgctctggtgcaatccgcattggggctgaatgtcgtgctggtggttcccttggtgatgttctccttgaccgcccacaataccgcatcagcatagtaggcggtggacttcacatcagcaaagggattggctgtacccgctgtcggggacttctcagaacgccacaggaatgtgacgatctgggcacgggagcaggtcatgttggggctgaacgtggtgtcgctggtgcccttggtgatgccgttttctactgcccacagcacagcgtcgtagtagtagctgcccacaggaacgtcggtgaagggcatggtgctggttttagaggcggggcttccagcggtgcgccacaggaaggtcacggcctgcgcacgggtgcagatgccgtccggggagaaatgggtatcatcggttcccttggtaatgccgttctccactgcccaatccacagcatcctcataatagctgccggtggctacatccacaaacacgccggtctgggggttgccgttggctttcataaagatgacctcgatggtatgggttctgctgacattctcaaaggtgtaggacttcaccgcgccgatgctcttgccgtcgatcttgacgttggcgacagcatagcccttatccggggtgatggtgaaggtctgatcccggccctcacggacgctgacattgccggagggagaaatggagccgccagccccggcagttgccttgatggtgtaatagctgtaagaatggccgctgccattataacgccagtgtgccgtataggttcggttgccagtgctgcccgttgggatggtgacggtcatattgttctcgccgtcaagccccgtgccgctccagccggtgaaggtatagccggatttggtaggattcttgagggtgaaagtcctcgtctcgatggtgtaggtgtcgggattgccctccgcagtgccgccggccagatcataggtgatcgtgtactcggtgggtgcaggcgcgtccttttcgaagatggccttgacctccacgttgtcgttcggcatgaggaacttgttgttcttgatggtcacgccgccgctgatgacttgccactccttgaagtggtagccctctttgggcatggcggtcagggtgatctccgtgccggtcgcagcggtggaaggagttgcggtgccggtgccgtttccgtcattgctgacggtgacggtgtaggtggtggggtaataacgctgttttcccacagcgccttgatctctgtgtccccgctcacggtataggtatcgcctaccttgtactccgtgccgctaatctcccaagccttgaactcctgatcggtgggagcggtgaagccgcagacgggcaggatgtaatttgtctctgccttgacgatcacgggacccatgctgccgctgccgccgttgccgctgaaggtgattgtgcaatccgcaagcggcgtaccctcacccacagtgacttccgcatcggtgctggcaaagtggttgttatcctccgcatagcggacgaagtaattgccagcggacaagttatcaatctccgtgccgctgcacgccgtatagcttctttcgcctgccatacggtattccatcttatcagtcacgccgctgattttgccgtcgctgccgcccacggtgatgggcgcgacaccgatcaagccgtcaggagcttcccgcgtggctttgccgatgctccacgctgcggtcacggcatcggtgctgccgtccacccatttgccggtcttggatgtgacgctaacggtgtaatcgcccgcgtccgtgccggtgttgccggagatgtccatagtagcgagatcatagccgttcacggtcgcggtatgcacagagccgttataggtatatgttcccgttacgctgatgttgggctttgcgggatcggtgggcacgggaggtgcgtcctcctcgaagatagccttgacctccacgttgtcgttcggcatgaggaacttgtcgtccttgatggtcacgccgccgctgatgacttgccactccttgaagcggtagccctcgttgggcgtggcggtcagggtgatttccgtgccggccacggcttttgcatgagatgcggaagccgttccgttcccgtccgttctcacggtgatggtaaattcggtgggcgcgggaggtgcatctttctcgaagatggctttaacctccacgttggcactcggcatagtgaacttatcgtccttgatggtcacgccgccgctcatgacctcccactccttgaagtggtagccctcgttgggcgtagcggtcagggtgatctccgtgccggccgcggcttttgcataagatgcggaagccgttccgtttccatccgttctcacggtgacggtgtgctcggctgcgggggcctctgtgctgatggtgaagtagtgctccgccttgccgcagtagtttcccgtgccgtacagcgtcaccttgggagcctttttgctgtcaaagccctcgtcgcccggtgtgagggtgtagggatggacgttgttggaatagatggcggtgtagtccgtgttctccgtaagctgcttcgttttgttctcgcccgtctgatgggaaagccccgtcagcttcttttcgctgccgtcatgggcgcagtccgtcagcccctcgagcgtcaaaagcccatgctcatagcagtatccaagatcatacttgtcgcagagcgcgcatttgccgtactcgtcagggctatggtcaatggtctttccgttgacggtgctgccgcagatggtgatgttttccgccggaataccgggcagctcctttgtgtgcagcttgtcatagacatagtttgtgccgtccttttcctcaagccggaaggattccaccgtgctgttcagaatttgaatctttccaatctctgaagctctgccagacgagtttttcccgatgccgggaatatagtcggtaccagacctcaaattgccgccctttgcggtcacggtgctgttttcaataagaatatttatctggcctccacttgagccatacgccgcgccgatggcggggccgaacaattcattgcgaacggacacctggctgttcgcaatgcggatacggctctcaccataggattgggattgtgtaccgttgccgataaccgcgttgactgaagacctactatcgatttggctgtcctgaatgtcgatgctgccaaaggaagccttttcgccgccgccaatcgtgcagcgattataggtgtactcatcgttcaggcggatgctgctgccgcggatcacgatctcttcaacggaagaatattctccacgtgcgccgatgatatcgcccgtcaacacgatgctgtccgtgatctccagctttttcagcgtctttgcatcattcggtgattgcacggtttcgtccatgaaaataccgtaggtgtgcagatcggaatcccggatggcgatgctcccattgccgccgacgcgaatgcctctcaaatgcggcagcctgatctcgccgttttcaataacgatctcgctattgctgcccacgcggatcccgtcggtatgagtggtgggtatgtccgtggattcaacgcggcagtttcggatggtgagcttcccacccggcgagtctgcgtcccagccgatcaggaccttttcgctgctgagaagcggaagctctgcgtccgaaatggtgatgcttccgacgcttccgccggcagctccgccgatgcaggcgccgtccttactggaaatggatttgatcgcattgccgttgatggtgatgcttttgcaatccacacgctcggaatagctgtccgtaaagccgccgatggctgcgccgctgccctcggcggaaacggtgagctcaccgccagtgatgcgaatgtcgcccttactgccgatgcctgccgcaccgccttttccgaccgcatggatgacgccgccgttgatggtaacgccgctcttgccgttgcctttatcgccaatggcggcgttattgtgattggccgtggcttctatctctccgccattgatggtaacggtcattgccccggtgttataaattctggctccgccgatgccgaagccctctcccttggcagttgccttgaccgtgccgccgttgatgatgacgctgccgctctcatacggcccgattccgtttccggagagcaccctgtgcgaattttctccaaagttgttgacgcccccaatggcggttacatcgccgccgttgatggtgatcgtgccgccatatcctgtggtgatcgcatcgcaggtagcctcggcgatgaccgttccgccgttgatggtgacgctgccgccatatcccatttggcatgtgccgatccctacgctgtccacagcaagaggattgccttccggcaaggcaaagggttcggtacggacaacgccgccattgatggtgatgctgccgccttgcctgagattgccaggcgtatctccgtcggaggaaacgttgcgatcataatccgatccgccgatggcggaggagccctgctgtcctttggcgtggatattgccgccgttgatgatgatcgtaccctcgttttcatagtagttgtcgttggcagcccacacgcgcacaccggcgccgatgccggacagtccagccacaggccacacactcttttcatgatcagacagctccgggaggcacgccgtcagcttgcccatggatgcctcagcggtgctctgggcgtatatggtgaaggtgtcgccctccttcacgttgatgccccacggtaccgtgaggtggcagtcgtccttcaaaatcagattgaccgcgccgtgggtgtccaagcggggcgtgatggtcacgtcgccctccaccacgtaccagcctgcgggcatatcgtaccacttgttgtcgctattgaaaaaatcctcgataataactctttccagcaccgtgtattcggtgcagaagcgctccttgccgtccgcgtccagatagcgcacgggggtttgctcgacagcgttgttcacggtaatgctcagcgcccttgtgtcgctgccctcgctgttttctgccttgacggtgaaggtggcggttcccgccgcagtgagtatgccgctgatttctccggttttttcgttcagacgtaaaccggcaggcagagcgccttcatcaatgctccatgtgatgggcgctgcgccgatggcggtcagggtatggctgtaagccttgcctgtcttgccgtccggcagactgtccgtggtcacgatgacggtataggtgtctggcacaaaccgcgccgtgagcgtggttacatcctccggaacgctatcaccgggcgcgtagagcttgccgtcgctgccaagccacttaaagtaattgcctgtagctccctccgggcgggtcagaccgtcggacgcaggcgcggtaaattcgctgccgtttttcacgatgatccgaatgctgctttcatcgcccagcttgccgccgccaaggtcaagagtaacggttttcagcccgtcaggacctatcgtgtcacggttcaaaacctcgaggacggggcggaaaccgacctgcgggttttggcccgcagcgtcgcggtggccacagaagcggctcgaatagtgcccgcgaaccgtacggcgccacggcaatctgatcacagtatcttgtccacacgaaaaaatcccgttccagtttttgatatatccgtcgtccttgtccagcagcctgtcccattcgttgctttggggcgtgccgcgttctgaatcacctgagcctgtataatcacttccctcggatggcgcacgcatcgtatagtccacaccgccggcggtgtagtctttgccaaaaatcaaccctgcggtgttcaggtcattccagcttatcgtatgcgttacggtatagtccgccacaaacaggctgtgggcatatttgttctgctctgcatactcctcggtggttgccatctccgatgtgagcttgtaggcgtccactgtcccggcgtaggtaaaggggacataatgcattgttttgtccggcagagagccgttcgccgtgccgggaatgctcacgccggagaggtcaaagtaataggtgccgtcgggagcgaggttgaactgctctgggggaacaaactgcgccgtcagcttggttacgtccgccggaacattatcgtccggagcgtagagctcgccatcgctgccaagccactcgaagtagctgccggtatttccgtcggggcgggtcagaccttcggacgcaggcgcggtaaagctctcgccggttttcacaatgatctggatagtatccgagcttcctcccaattttccgccgccaaggtcaagggtaacggctttcagcccgtcagagcccagcgtgccggggttcaggacttcaaggacggggcggaaaccgaggaacgggaaggagagcgtagtattggcgccggcatatttgcggggcaaatcgtaccggccgcgaatcacacggttcgatagcgtattgggtaaagtatcttgtccccaggaacctatatttctccagtttttgatatatccgtcgtccttgtccagtatcctgtcccattcgttgctttggggcgtgccgcgttctgaatcacccgagcctgtaccaccacttcccccggacggcgcacgcagcgtatagtccacgctgccggtggcgtagcctttgccaaaaatcagcccttcggcattcaggttatcccagcttaccgcatgcgttacggcatagtccgccacgaacaggctatgggcatattttttctgctctgcatactcctcggtggtggccatctctgatgtgagcttgtaggcgtccactgtcccggcataggtaaaggggacataatgcattgttttgtccggcagagagccgtttgccgtgccgggaatgctcacgccggagaggtcaaagtaatagacgccgccgggagtgagggtaaactgctcatcaaactgtgccgtcagcttgattacatccgccggaacgctatcgccgggcgcgtacagtttcccatcgctgccaagccactgaaaataactgtcggtatttccctccgggcgggtcagaccgtcggacgcaggcgcggtaaattcgctgccctttttcacaatgatttgaatatcctcagagctgccgcccagcttgccgccgccaaggtcaagggtaacggccttcagtccgtcagagcccagtgtgccggggttcaggatttcaaggacggggcggaaaccgacgtacggactggagcgcgtagcacggttgtagccccagaagcgggccgaactgtacccgcgaaccgcacggctcgtccacgaagagcgcgaaatatcctgcccccacgaatgcatcctgctccagtttttgatatatccgtcgttcttatccagtattctgtcccattcgttgctttggggcgtgccgtgttgggaatcgcccgagcctgcactatcgcttcccacggacggcgcacgcagcgtatagctcacaccgccggcggtgtagttcttgccgaaaatcagccctttggcattcaggttatcccagcttacctcatgcgttacggcaaaatccgcaatgaataggctgtgggcatatttgctctgctgtgcatactcctctgtggttgccatctccgacgtgagcttgtaggagtccactgtcccagcataggtaaaggggacatagcgcattgttttgtccggcagagcatcgttcaccgtgccggggatgcccattgccgagaggtcaaagtaataggtgccgccgggggcaaggatgaactgctcgtcgatttcacccgccgcgaaggccgttgtcggcagcagcgtcagcaccatgcagcacagcagcaggatgctgaggattcgtttcttcatgtcctttttccctcctgttcgtgtcggttcggcttatccgccccgtcttttttctgattttctctttttctgagccggaagcacagcgcggtgatcgccgccgccgcggcaaaggagacgacagccaccagcacatagccgcccgcatcctcccgcagcagcatcgcgccgaacacgccccatacggctgtctgtcccggcccgacgaccgtgcccgctgtctgcatcagcgccgcacacagcagcatacacgcggcgctcagtccatagatgccgcgccgttgcctccggcggttgttttcccgcacccgctgcttgacgagtgcgacccgtcttgcggtatcgtacatttcgtttgaacctcctctctggattttttgaaatgcggcttaaaaaccccttcacttatataggtacaaaaaatcgaaaaaactctcacccaaaacgcaaaatttttcaaaaaaatttgagagccgccaaaaagcagctctcagggagtggctattcggttatttcctctgcccgaggcggaaagcggacagctctcccgccgccaccagcagcgccggcagggcgtaggccacatactgcgccgcgccgccgtaggcgatgagcagattatagatggcgtggagggtgatggccgcgcccaagaggccgcaggtgcctgcgatcttcagccacgtccgctgccacgtgtatgcaaggccaccgccgacgatcaagccgcagatcacatgcatggcccccgtgccgaagccccggaagaaaatgaaggagaagcggtctgcgccgttctggatcagatagcagacgttttcaaaggtggcgaagctcagggcaaccgtgatggcggcgggcttgatcttatcgccctccggctcgaataccagaagatagaacaccagcggcagcagcttcatcatttcctccaccaccggcgcgatctccgccgtggcggcaagggcgtccgcctgacacaccgccgcgaggaaggtgttgatataggccgaaagcagacacacccccattccggcaatgcagaacaggaagaagcggagctgccgcctgcccatgcacagggcggctaccagcagcggggataccatgcagaggaagatgttttcgatgtaggtcatgcgtccaccgcctttctcgtggcgggcagcagccccagaatcgcaagcgtcagtagcatatcacaccagaaggtgggacttgccggtgaggtatccggccagaagcagcccgccgtccacagcagatattccgaaccggcaaagcacagcacgccgatgtggaagcaccgcatattccgcgccgcgcccgtctgtccgttggcgtagaccagcccccgaatggcgcagaaggagagccatatcatcatgccgcaccagatcaggttggagagaatgtccccaaaggtgcagtagaacgccagcagcggcacgccgaacgcaggcgcgagccatgccctgcggcagcggaagctgcgctcgtcctgactggcgagcgtggcctgcaaaatgcgcaggaaaatgacgctggccacccagccgaactccgagacatagaaaacccgcggcgtggtatcgaacagcagcagatacagcgtccagtagagcgcgccgagggcaaagcagccgtagaagcacagcagcagaaaatacgcctgtcgcccacttttccggtaggagatacccgagagcagcgcgcccacgaacgtgaccagcagttgcagcaggttctcaatcagctccatgcgcatcctcgctttcctcgttctgcccgtcctcccggttcatctgccgcagccggaagcacagaacggtcacgcacacgccgagtaaaaacgccagcagcccgatgacgatgtatcccaaggcagcgccgccgccgtacatactggccgccgtttcaaagccggagtagtcgcctgtctggatgcttgcggcaatgccgggcatggcaagggacgcgccgatgagcagtacaaggcacgccgccacggcagaagccatggtgatcgtattgcgccgcagccgtttttcccgctcaatttgggcgatgcgccgcttcgtctccgcgacgcgctcctcatgactccgcatttgtgattccctcccgttccagcagccttcgcaggctttcttttccgcgatacaccatgttggtgatctgttttaccgttttccccgtgacctccgccgcctgtgcgtagctcatatcctcgaaataggtgaggtacaaaacctcccggtagtccgggttcatttcatccatgcagaagtgcaggatgcggtttcgctcctccgtccgtatgacctcctccgccagcagccgtccgtccggctcaccggtcagcgcatcgaggctgaatagcggttttcgcttgctcttgtggcgcagtgccatgtgccgcgccgccttatagagatacgccttgaagccgccgtcccgtacttttggctttttcgtgaacagataggcgaaaacatccagcatcagctcctccgcctcgtgaacgtcgtgcagatagccgtcgatatacagggtcagggggtcgccgtattttttcatcagggcattaagcccttcgtcatcaccgctcagatattggcggtacaagctctcgtcgcaagtcatagcgttcacttcctttttgcggatgcttccaattccaatgcggaggggattcgtcaggtgcttgtcctgccggaatcgcggtgctgccccttgaagcgcgggtcggagggcttttccgcgttttccgggatcgcccatgagcgcccgaaccgggacgcgccggggatccgcccctcggcgcaatattggttgacccgccgctccgacacgccccaacggtaagacgcctcccgaatggagatatagcccttgatcccgttcataccgcacctccgcatggataatactcaacacgatacattatatacgaatatccgaagaaacacaagacatccggcgaagtgttcagagaaaagttacggataggagcgacattttttgaaaaagtcctccgaaactggccaaaacgcccctttcggattgtagtatgggtagaggggaaaacgggggtacgaacgggggcaagaaagcggcaagcaatgcaaagcggtacccactttgcaaaaacaggcggattccgtttacacggagcccgcctgtttcatgcttgttggggcgctgccccaatccccgcagaacacaaaaactgtgttctggaacgatggataaatccatcggctgcgcgattttgcaaatcgcttatgggcaggcagctcagcgctgctctgcctctttttcccgtcgttcattcgcttcctcctgctccttatccagctccagaatacggtcgatattggccttggccgtcagcagctctttcatttcctcacgggcttttcggtagtcggcataggcggctttcttctccgccagcagctcggcgtactcggtattcagcgccttgatggtgggcagcttcttgaagcccagtccatcaaaatagttctttgcggccttgtggatcgtgatctcgctttcatgctctgcaagaaatttcttggagtacccggccttgcgataggcaacgtaggtatcgcgggtcttggcgtaattggcaatatgctcccgcagcaccgcaatctcagccatgcgcttttccgcagccttaatccttgcggaaagctcattgaagtgagcggacgctgccgccgctttctctgagagaacggcgtaatctaaaagctcatggtcttgcagataggccaccgtctgtgccatctgcttcaaattgaacaacgtcgcccaacgcgcataaccggcacctttgccagcgcgtaattttgtctgaatgtccaccagcagattcccgctgcgcttttccggtttgaccggtgcggcggcgctctttcgcggcgtatgcgccttttcacctgcaatcaccgcacgaagatctgcgggagtataaccgtcgccgagggtatccatgcgaatggattttttctgttcgccgcctaacagggacgggactttcttgcccttgacctcatacccggcctgccgcagcagctccagcagcgtttcaaagctgtcgggcttttgcgccagcgcatcgtcaatggccgcgcatatccgctcccggtgggagggcttctttttgtcgcccagccacttgttgtagctcttgccgtggcgcttcggattctccacgatggagtagccgttctcgatgcagatggtatcgttgagccgccgcacggcgcggctgctgccccaaaagtttctgaatttccgggtctggctgagtgcggtggagttccagatcacatgattgtgaatatgggctttgtcgatatgggtgcagacgatataggcgtgattgcctttggtgaatcgcttggccagctcacagcccaaacggttcgcttcctccggtgtgatctctccgggaacgaaggactgccgcagatggtaggcgatcacatcatcctcgccgcgcactctgccggtcttgtgggtgtattgatttttggcgaaaaggaactcggcatcggcgatcctgctgtcgcactgccagcttgttatcagcctgccgccgtccgtcttttgcggattttcggtgtagtcgatgatagcgctgatggcctgtcccaccgtgcggcctttgccggtgtggagaggcatcaggcgtgtggttgccatgttggacacctccttgaaaagtcaaacggcctgccgtagcagaccgtttgaaatgtgttaatttgcaagaggtaaaagcaaactgatagttcgacaaatgggaatttgaatactacgattttatgagcgattatcgctcaccgtgggttttcaataaaatcctccaaaagccttgaaaacaaagggtttttcgcagcgtgttcgccttatccctttattcggtttcacacaagtttacccttgccctggccactcataagggcaaaagcaagggcaagaaaatctcgcaacaggatatggcaacgtgtggcaatcggggaactgtgacgtatgtgcgaatatattatagcggaggattttattatggacaagtacatttttgacaagaacaacggcctttggtatgaactgattggcgactactatcttccctgtctgaccgtacccgctgaagaaggacagcctgttggcgtatggggtcagcggcacaagcggtatctcaaagaataccgcccagccttttataatgctttgctgttaagcggcaaactgaatggctaccttgccgatattgaccggcaggcacaggagcaaatggtcaccgtcattcggcaaatgtcgaaggcccaaggaattactgaagtgttgaaagctaccaaccaagcggagtgggtaggaatgatgaataatatctgttttgcggcagtagaaatgattcatgatgaaatcatatacgcataagtacgaaagcggctggggatataccctgccgctttcatgctcgtcaaaacagttatctgccagtgaagatgcagccctctatatcagtaattgaaaataagacaaggcagactaaaaggagagggaacaatactttgcaactttcaaccccattttgttgcatttcacgccaggcaaaaggatgttttgcaaagaaaatcaagcaatgcgaaattaaaatataccctcttgacaaacgaactataattctatatactcagttctgtcaattgaataaaatcttcagggcagggtgtaagtccctaccggcggtacagcccgcgagccgaaaggcatgattcggtgaaactccgaagccgacagtatagtctggatgaaagaagatttgcagtacacagggatgaagtttatcaccctgtgcgtgtaagttgctctggattgttttcaatccagagttttattttatgccggcgctatgtctgtgtctatctgcgtcgccctgaacgatttgttcagggcgatttttgcttttgaggtgatggtatgagtgacgaggattatatgtctttggctttgcattttgcaaagaagggagttggctggacggccccgaatccaatggtgggcgcagttatcgtgaaagagggccgggtgatcgggcggggctggcatgaaaaatgtggacagccacacgccgagaggaacgcccttgcctcttgtaccgagccctcggagggagcgactatgtatgtcacactggaaccctgctgccactacgggcatcagccaccatgcacggaggccatcttaaacgtcggcatcaagcgggtggtggtaggttccggcgatccaaatccccttgtcagcgggagaggtattcaaatactccgagaacacggaatagaggtgacggaacatatcctggaggacgaatgtacccggctgaatgaggtgttcttccactacatccagacaaagcgcccctttgtggtgatgaaatacgccatgacgctggacggaaaaatcgcaacctatacaggggcctccaaatgggtcacgggagagcaggcaagaaatcatgtgcaggagcagcgccaccgctacaccggcatcatggtgggagttggaacggtactggccgacgatcccttgttgacctgccggaaagccgggtgcaaaaaccccattcgcattatctgtgataccgatttacgcactcctctaaccgcccaagtagtcactacggcaaaacaggctcctactatcctcgttacctgctgcgctgaccgtgaaaaatggacgggctacgaagaagccggctgccgtattctgccggcggaacggaagaatggccgcattgatttggagcggttgatggaacggctggggcaggagggccttgacagcattttgttggagggcggcggcacgctgaactgggccgcgctggaaagcggcatcgttcagaaagtgcaggcatatatcgcgcccaagctgttcggagggcagacggcaaaaacgccggtagagggcgctggtgtaccgttgcccgactgtgcgttccagttgaaaaacatggttatcacgcagttgggggaggacattctgctggaaagtgaggtggcaagtcatgttcaccgggattgttgaagaaattggaacggtgacacaaatccggcacggcccgcactccgcaatcctcaccatagcggctgaaaccgttttggaaactacgaaaatcggagacagcatcgccgtcaacggtatctgtctcaccgttaccgctttatcggacacctctttttcggcggatgtcatgcacgaaacgctgaaccgctctgctctgtcccggctgggtacgggaagtcatgtgaatttggagcgggccatgcccgcggacgggcgttttggcggacatatcgtggccggtcatgtggatggcgttggaacggtggcaaatgtgcggcgggacgatacggcagtctggttcaccgtgcgggcggcgccggatattctgcgctatatcgtggagaaaggctctgtggcgatagacgggattagcttgaccgtggcggcagtcacacagacggatttttccatttccgccattccccacaccgtggcgaatacggttttgcgggaacggaaaaggggcgacccggtcaacctggaaacagatgtgattgggaagtatgtagaaaagctgctgttccccaccatgggcaggcggcaggataccacaatcaccaaagaatttttatctcaacacggattttaggagggcaggcaatgatacagttcagcactattgacgaagctctttgcgaccttcgagcgggcaaaatcattctggttacggatgaccccacacgggaaaatgagggggacttcatctgtgcggcggaatttgccacaacggaaaacatcaatttcatggcgacctatggcaaagggctgatttgtatgcccatgtcgcaggcttatgtggaaaagctgaaaatcccgcagatggtacagcaaaatacggataatcacgaaacggcttttaccgtgtccattgaccatgtgaccacctctaccggcatttccgccgctgaacgctctgtgacggccctggcctgcgtgtcagaggacagcaggccggaggattttcgacgacctgggcatatgttccccttgctggcaaagcgaaacggcgtgctggagcgtgacggacataccgaagcaacggtagacctgtgccgtttggccggtctgaaagaatgtggcctttgctgcgagatcatgcgcgaggacgggacaatgatgcgtaccccggagctttcggaactggcaaaacgatggggaatcaagtttatcaccatccgggatttgcaggcttaccgcaaatgccacgaaaggctggttgaccaggtagcggaggtcaacttgcccacaaaatacggggaatttaccgcttatggttttgtaaacagattaaacggtgagcatcatgtggcactggtaaagggtcagattggtgacggcgaaaatgtgttgtgccgtgtccattcagaatgtctgaccggggacacgtttggttccctccgctgtgactgcggtgaacagcttgccgccgctcttacccagattgagaaagaggggcgaggaattttactctatatgcggcaggaggggcggggcattggcctgatgaacaaactgcgggcgtatgagcttcaggagcgcggattggatacattggaggccaatctgaaactgggctttgccggggacgagcgggagtattatattggcgcacagattttgagggagttaggcgtaaagagtatgcggctgctgacgaataacccggataagctctatcagctttcggagtttggtttgaaaattacacagcgtgttcccattcagatgaagcctaccccctacgacctgttctatctgaaaacaaaacagacgcgcatgggacacatcttaacctatgaaagagaggaagatcgccgtgaaaacatttgagggaaaactggtagcaaaagaggtcaaggttggcatcgtggccgcacggttcaatgagtttattacatctaagctgttagatggagcattagacggcctaaagcggcatgatgtgtgtgaggaagatattcatgtcgcgtgggttcccggcgcgtttgaaattccgctgattgcatccaagatggcaaaaagcggaaagtatgacgctgtgatctgcctgggggcagtaatccgaggctctaccagccattacgattatgtttgcaatgaagtgtccaaggggattgccgccgtttccctggaaagcggtgtcccggtgatgtttggcgttctcactacggagaacattgaacaggcgattgagcgggccgggacaaaggctgggaataagggctatgattgcgctgttggtgcgattgagatggtaaacctgattcgccaactctaagtaaaagggccttgcagttttatgatgccaaccgtttatgtacgcaccgcatggccttctggctgtgcggtgctttttgccgtcagtcctttgtgtaggcgtccacgatacgtacttccaactcccggttccgctccatcgccctgcggagttccggcacttccagcaggcccttggcgttggcaatgatgaggatacgattgaggctggcccccaccctgcggacttcgtagatcagcttcggcacgtcaacggagggggcctcccggatggcagcgccgctgatacactgccggataaaccgctcacgggaaccccgtaccctgctgaccttttcgttgaggtcggccagttcctcatcagacagacggatgatgatttggttggttctgcttcgcatagattctccttcctccggggtcataggggtggaacccctgtcaagcggtattgtgatatcacaatacgttgcttgctaagactgtaccacttcccccatggcgtattttgcgggtgcgtccccgccgccccggttgctcttttcagccggtaaaaaaccgtcactcgaccctgcggacatcgccctcccggagcagattccgcccctgattgacggccatgaaccgttccagcgtgtcccgacggatgatggctttccggcctactttcagcaccggcagcttgccccagtccaccagcttccgcatggtgttccgcccaatgcccgtacactcggcggcttcctcaatggtcagccccattttaactgcgctcattctgcacgcccctttctattgcgcttgttttgcaaccgcaacaccgatattatacttaaagcgccgtcatctgtcaactcgttttaaggcgtattaaaaaatatttttgaaaatatacgtaaaattgggttgcaaatcaaacccagttgtgctatactcatactcgataggaggtgaacttcttggacaacgcagaaatgctcactccaaaagaagtgggaaaacgtatcaaagagcgccggaacgagatcggtatctctatgccggagcttggacggcgggtaggggtcaacaagtccaccatccagcggtatgaaacagatggggtcaatcccagccgcagcatgatcatcaacggcttggcggacgccctgcaaaccacctcggaatggctcgtagggctgtccgaggaaaaggaaatcacggcggcggacgatgatagccgcaccatctgcgagggcgaggtcttagaccacctcaacagcttccttgacgctgtgaccaaaacggtacagccagaagtccagcagcggtttctgacctctacgctgtgcctgctgatcgacctgttctccattactgcccagcactatggcaggacgctgaacgagatcgaccggctggccggggatgaagccctcaaaaaatccatccagcagtacaccatccacgttgacgacatcatcgtgccggtctattgccgggagatggaagctcctattgaggatatgaagcggttcctggacgggctgctacatatcttcgacaaagggcgtaccagggtagatacagtttatctgtataacatcctgcatgacgcccaagtgcggctgaacgccgccaacgattccgtggcaccttgacaacataatatgccgggaaaacccggcagaaatgatgcaacgcacatcatacgtcacaggcccgattgccacggatagaaaggagcatttcatcaatggcaaaaggttctgtacgcaaaaagggcaaaaagtggtactaccgcttctatgtggaggacgagagcgggcggcaggtacagcgggagttcgccgggacagagagcaaatccgagacggagaccctgctccgcaaggcgatggaggattacgaggcgaagaagttcgtggcgaagtctgaaaacgccaccgtggggcagttattggatatgtgggtagaagaagaactgaagcccggaaacctcagcaacggcaccgtgatggcctaccaagggacggtcaaccgcatcaagcagcaccctattggaaaccgcaggctgaaaagtgtcacccctgaccacctgcaagcttacatcgacctgctcagcttcggcgggacaaacccggacggcacagcggcaaaagcgctcagcaaagggtacttacggcagtattcggcagtcctgcaaggggcgttccgctttgcggtgttccccaagcggctcatcagcttcaaccccatgcaatatgtagtatggcgggggaagaaagaggaatacgagctgttctcccaggagaacggggatgccccggcggtgcccaccctcacccatgaacagttccgggcgttggaggactttctgaaaaagaaagacaatccggccctgttgcccattcagattgcctactacaccgggcttcggattggggaggtctgcgccctcacctggcaggacatcaacctggacgagcagtatctcacagtgcggcggagcatccgctacaacggggcgaggcacaagacggagatcggggccaccaagcggaagaaagtccgtaccgtggatttctgcgacacgctggcggcaatccttcggagggccaaaaaggagcagattgggaaccgcctgcgctatggggagctttacagcctgaactactgcaccgaggtcagggagaaagaccgggcctattacgaggtctacaccctgcccaggacggtggaagtgccggaggggtatagggagctgttctttgtctgtctacgccctgacggggccattgagacgccggggacggtaagcatcatgtgccgtcaggcgaagaagaaagtgccggggctggaggatttccatttccatatgctcaggcacaccttcacgagcaatctactgtccaacggggcggctcccaaggacgtgcaggagctgctgggtcacgccgatgtcagtaccacgatgaacatttatgcccacgccacgagggaagccaagcgtacctccgcacgtctgctggataaggtggtctgcggggagtaaaaagtttcccttgttccagcccgtgagggcaaaaacaagggaaagtacataaggcttgaacatttaatctgtgggaagccttgacatattagggtttcaaggggatttaacaaataaactggaattttcaaattagtctttgcaaataacctttgaaccttcaccatcaattacaattccctgacggttgttaattgggcatagattcaaatccgaaaactcagtcattattttctcggtaactttcttaaatggtgctgtaagataatgcggaagaacatagaaatcaatcaaatcaagccctgcatcatcttcttgtgagtagtcctccggcttttcatccatttgctcgatatattggatgcttggagcgcatataatcgcacctgccgattcaccaatcatcagttttccctttgccaattctttcttcaacagctcatccgttcccgttttacggagctggtctataaggaaaaaagaatttccgccggtaaaatatatcacatccgcatcttcaaaaacagactgtatcgttgaataagcctccgttgaaatatcaatttcagttacgattgctcccaactttttgaataattttcgagccgagccgacataaccggtgtagccttcacgcagcgaagctgttggaataaatgcgacttttttattttcaatttcttcctttatcagacttcctacacttgaaaagtgcgaacataaaaacagtttcatcaatattctcctttatatataaattccgatttgctgctctctattactcccgtgccagttcatataggctgcggatggattccatgaccgtatgccacgacaggtcggcggcataggaaaacttcttctgataagcccgccacagcttttccatgtttgggtcggcctcaacttcatcaaaggccgcaggcgcgtcggcaagatacttctctgtaccgcgtttcctggccgttgcaatgagcgccgcacggagatcggctgggacgatgctctggccgtggagctggctcagaatgtgcagatcatagaaatctctcatgcgggtgttggtggtggcgcgggacacgacagtttccagcttctcagccagaacagtttccagattgtacgccaaaatttcaatggaacgatcctccagcatcagcttgaagctgtaacgcacttcgcggggcgtgatggcgtcgccggtggaaatgtcgatcttgagcggcgttatcacgccgtcaaactccgtttccatgctgacacggatgcccggatactcggcctcgtccatgatctcggaaatgcgcttcacccggaaccccacgccatcgtccaccggtacggagatgatggaggcaatcatgttctccacgtcctcgatgccgaccgtcgcaccctttacggtcgcgtcaatgtccatcgtggagcgggcgtcaaggccgaccattgcagccaccagcatcccgcctttaaggatgaacttgtcccgatattccgaaagagaaatgcgctccagaaagcgctccatcatgtaattgcgcatcaggatttgcgcatctgcggatttgtccttggagagattgcgtatcaggtctttgagctgccgtgcagtcttaatcataagagtacctccaaatactgccgaagcagtttttcaacacggaacatctgcgcatagcgcatcagcttccgcaagtccttgtcttttcgttttgcgtattgcttgagtgcatcctgaaaggtctgcatctcgattccactacggctgcggatcagatcgcagatggtacgctccatatcatagacgggaaccgagttgccaaagggcgtgttcatcgtgacgatccccacatcatgcaattctttcttgatggtgtagaccttgatgccgtctgcttgcaggctggcaggattgtagccggtcttgaccgtgatggaatacggattcggctcccggtcggtcaggtcatggaaaaacagcgcgctctcatgggagaatacagcctgcgcacaacgaaggtgcagcaggtacatggcgtccgtccatgcatctggcgaaacataaacgccatgcgcggcctgctctacgccgcgctgcttggcgtaggcgtaaaacgtggacttggcaataccgatttccaaaacctgcgcggttttgacgatcccattgttttgctgaaaaagcagatcaagccggtcgtaggcggtcatgttatcacttccttcttgctaatattatatccgagattagcaagaaagtaaacaacgattttagaaaagcaagccgaggcatcgccccggcttgcgctttaactatggatgaagtttttcatggcagcgttcacgtcttgcagcttgccaagtccctgcaccgccagcagcggaagtcccatcgggctgattagaaacgccagcacaaggaggataatgccattttttacagagtaggtaatcatcacggcgatggccaacagggagagcaggccgcttgccagcttgaacgcgaagccggagcaagacagcagccccgcgcacagccagacgaacagggacaggataagcgatagcggcacaaggataattttcagaatggacatttgacggcctccttttcaaagacgttatgcttttctaatatcagaataccatgacagcgcgcgctttgcaacaatgcgaggcttttgctttgtgtgaacaggggcggcggagtgaccgccgcccctgcgacttatttcagcgccgccagcgaggaaacgattttctctgccgccgtccatatccgttcctgactttgctgaatgtcctccaaatcggcctcatagatgcggcctgtttcgtgagcgcggcgggtaagctggttgaggttgttgctggaataccgaagcagggacaccagctcccgcagctccggaaggtcgagcttcaccacatatccgtcaatcgccatcttgcggagatacgccgccatgttggtggtgccgaactgcgccatcttcgtttcaatcatttcccgctcctgcggcgtgacgcggaatttgagctgaatatcccgtttgcgctttgccatcgctcagcgctccggggctttggacttcgccgaaattttcggcgaagttgtttcaggcggctttttcagcttatcccggacagaggttttctgccgctcctgtgcgtaggctttgcgggtctggctgagaaacagatccaccagaccgggatggctgttgacggccagatagcagttgcggtcagtaccccatgtgtcgggattggcggggatggacatggcgtttgtccatgcccggttgtcgggtgaataccgtctgtcccaatccgcttgacagacggtaatggcgaggatataaaatgcgcggtcatagccgaactgctgcaccacctgatcgactgccgctgcatccaaccggttatcccggtagtggtcacggatggcggtttcaatcgcttccttgcaggccgtgttcgcttgattggaagcgcggtaggccgcaagctcgtcatgctctctggcataggatgccgggtgtttgtaaacggggagatttttcattatcgtgcctccatttcttttttgtggggcttttccggtgtgccatgaacgggcggcgctttcagcctgtccagaacggaaggccgcgtcgattttgcaatcgcctgctcaggctgcggctgtcccttgccgtccagattcagttccatatccaactcaatcagccgcgcagttttcgcggccagctcctgctcctgcgggaatggcttaccgacctcagcctttgccgctgcctgctggttatagaggttttcaagctgctcctgaacgctgcgcagacgctccggcattttatccagcgcgttctcgatgcggacaaggttgcctctggcatccgaaccgagttcaacgcgatgggtcatctggcctttcagcgtcagcgtgtacgttttccaaatggaatcaaaagcaacggacatggtaaagccgcgatagctgccgatctgtaccgggtctttgcccttgacctccttgcaggtgtccagcagtgcggcaccggcgttttccttatcggtgagccggtcgccgcgaatctccatgccgacaaagccctctgccgggagcggatgcgctgcgagggtctgcatatccgcctccagtccacgaacaaagcccttgtgttcttctatcttttccgggaagtatttcagcagactgtcctccaagcggaattgcttgctgttgtggtctgccttcataattttgagcttggacacctcgatgtccaaatccatacgctctttgatgcggggatcaccggcacagagcgccttgatctccgcaaaggacagcgccgtggcgtccacatcctcacaggagcgaaccggggattttgaggtcatgatctgagagatgaatttctgcttattttccaccgtttgccagaggtaggcatcaaacgtcccctcggtcacatagcggcatacatgaacgagcttgttctgattgccctgacgctcgatgcggccttttcgctgcgtgagatcacggggacgccacgggcaatccaaatcgtgaagtgcgaccaaacgatcctgcacgttggttcctgcgcccattttggccgtgctgcccatcaggacgcgcacctgaccgctgcgtacttttgcgaacagctcccgctttttgacctccgtattggcgtcgtggatgaacgcgatttgttccgggggcataccggcgtcaatgagcttttggcgcacatcctcatagaccgtgaacggcgtttccgcgctttcctccaatgaaatcgcactctccagcgcatggatttccgggctgtccagcgtaccgggggaagcctttgccgcccgctgtgagggcgtggtctttggcgtagaaatgtcgcaaaacacaagctgtgtcagtttttcctcctcgccgtcacgccagtattggagaatgttcgccacgcactgattgaccttggtggtttcctcgtcggggagcatgggattgatgatgcgctggtcaagccccagcttgcgtccgtccgaggtaattttgagcatattgtccacatccgggctgaccgcaccgctgtgtaccttggacgctcgttccgagagggctttcaccatgtcctgctggatctgcgtgggtttggtggcgatggtgtggtacgcaacctccggcgtgggcaagtggagctgatccgccgttttgatgtcggcgacctctttgaacaggttcatcaattcgggcaagttgaaaaactttgcaaagcgcgtccttgcccggtagccggtgccctccggggcaagctccagcgcggtggtggtttcaccaaagcggcttgcccagcaatcaaagtggcccatacccatctcttgcagccggtcatgctgcaaatagcgctggatggtgtaaagctctgtcatggagttggaaaccggggtgccggtggcaaacaccacgccgcgcccaccggtcagctcatccatgtagcggcacttggagaacatatccgaggatttctgcgcatcggtggtagaaagccctgccacgttgcgcatcttcgtatagaggaaaagatttttataattgtccgactcgtccacaaacatcctgtctacgccgagctgttcaaagtaaatcacatcatccttgcggtcgctggcttgcagctttttcagccgcgcctccagcccctttttcgtgcgctccaagctcttgatggtaaagctgttgccgcctgcgagcttggtatcctgaataccatcggtgatttcctcaatctgctggtgaaggagctgttcctgccgctccggactgatggggatacgctcaaactggctgtggccgatgataacggcgtcatagtcgccggtggcgatacgggcgcagaatttcttgcggttgtgggtttcaaagtctttcttggtagtgacaaggatgttggccgaagggtagagccgcagaaactcagacgcccactgttccgtcagatggttcggcacgacaaaaatggatttctggcacaggcccaatctcttggattccatcgcagaggctaccatttcaaaggtttttcccgcgccaacttcgtgtgccagcagcgtattcccgccgtacagcacatgggcgatggcgtttttctgatgctcccggagggtgatttccgggttcatcccagagaaaacgatgtggctgccgtcatactcgcggggacgagtgctgttcatttcctcgttgtattgccgtaccagcgtttcgcgccgctccgggtctttccaaatccagtccttgaacgcatcccggataagctgctgtttctgcgcggcaagggtggtttccttggcgttgaggacacggcgctcccgtccgtctgcatcctcaatggtatcgtagatacgaatgtcgcggagattcagcgcatcctccagcagccggtaggcgctggcgcggtctgtgccgtaggtggtgaacgccgccacatcgttgtagcgcaccatgctcttgcgggaaacctgccattctgcggtgtacgggacatagctgatctcgatctgtccgcgcagatagcggggcgtttcaaaggtttcatacatgaattgctcgatgtacttcttatcaagccatgtcacacccagccgcacctcaatctcgctggcttcaaggtctttcggctgtgcggcgatcagggcatccacattcccggcgaagaatgggtcgcgcgctgccacgcgctgcgcggtgcggagcttctgccggacgttgccggagagatattcgtccgccgtttgccagcccttcgcccaatgctcgccgccgtcctgcaagtcaaacgggccgctgttgggttccttgtaaatgacacccttcaaatcctcaacgatctgcgggattttctcgctgccgcccatgagggaggccataaagtcgagatcgacgcaggctttttctccgatgcagacagcaagggcttcactggcggtatccacagaatctacgctgcgctgctgcttgatagtgcgcttgtggaacatatccgccttgcgctccagctttccgtcgtcatccagcacttccagtgaacacaggaggtagtaagaggaatcgtcagagaacgcaagacggttcgcacggtcattgattaggccatgttttgcggagaacgcatcatagaggcggtttagctcggcctgtgcttcctgaatccggctttctgcgctgtactcgtccatttgcagggcaatcagctcattcacgcaatcccgcagcgcgaccatgcccttgacacgctcggcggcggtggcgttcagctccggtttgaccatgcggctgttttcccggtaatacacctcgccgcccaccacggtgtaggagtagtttttcacattggggtctgcggggatagacgtgtcgatctgttcgccctcacccagctctggcagttccgcctcctgataggtgccgcgaatgtttttcacggcatcatggagctgatctgcaagtttcagcccctcaatggggacaacggtgaagtcctgcttgccgtattgggtgctttcggaggtctgcctgcctaaaatcatctccgggtggtcaacaaaatagcggttgatggcaaagccatcctcgttctggccgaggtatacccaatccggttcgatctcaatgggacggtcacgcttttggagaaagagaatgtccgaaaccacatccgtaccggcgttggcgcggaacgcattgttgggcagacgaatggcacccagcagctccgcccgctgcgcgatgtacctgcggacttcgggcgattgcttgtccatcgtgtagcgggaggtcacaaacgcaatcacgccgcccggacgcacttggtcgagggttttggcaaagaagtagtcgtgaatggaaaaaccgagcttgttataagcccggtcatctacctgatattgtccgaacgggacgttgcccacggcaaggtcgtaaaagtctttcctgtccgttgtttcaaagcccgcgatggtaatgtccgccttgggataaagctgcttggcaatacgtccggtgatgctgtccagctccacgccgtagagcttgctgccctgcatctgctccggcagcaggccaaaaaagttgccaacgcccatagacggctccagaatgttgccggtctgaaagcccatattgccgaccgcttcatagattgccttgatgacggtggggctggtgtagtgggcgttcagcgtggacgctctggccgcagcgtattcctccggggaaagtgtggcgtaaagctctgcaaactcgtccgaccagtttggcttattctcgtcgaaggcatccgcaagaccgccccagcccacatagcgggagaggatttcctgctgctccgggctggcctgtaagccctcaaactccagctcttgcaggaggcgaatcgccgccatatttgcccgaaactttgcttttgcgccgccgacgccgagggcatcatcggtgatgtggaaattctgcgcgtcgcggtggcttgccgccttgaagtcagcgtaagcggcctgctccgcagcggcaacgctgtgaaattcctgccactcgccgtcaacggggatggataccgcaggacggtgtgcgggaggctcgtcgatctcggcctgtgagatggcatcatcaaaatcaggcacaaactcgcccatttccgagagtgccgctcgaccttcatgctccagaatcagcctttcttcctcgttcatagcaggaggttcaggcttggcgggttccgcagagggcgggtcatgctccggctcgtcaaagcgcagggtgcgaatctccacatcataggggaggttgtttttgtcagcgggatacaccgccacggtctgctcggtgtaggcgggtgcctgttccggctgcggataccgctccatgagccgtgcgaagctctccctgctctccgcacgggaaacgggatagcgaagcgacggatcgcggagagaaatatcaaaaagaccgatgctctcaataataaacggcttgccgtcctccaaatataccgtatcgcctacggaatacgggaacggttctctctgcgggacaggagctgtttcgggaacgtctgtaactgcttcctctggctcatgccagcggtattgttccacatcctcatccgaaacatgaatgaggtcgctgaaatcgaggttttccagctcgttggtaataatctcttgcaaagagccgtactgccgggtttccagatgctcgtcatccagatagcgctccagccggtaattcacaaggtcaatgttcacctgaatgggaatctcatcgtcggtgacggtggtgtaagcgacgccaatcttggtggggtcgctgaaatccgcctctgagccgtattcactccggcagaagtcggagatcagtccctttgcacgttccatgagcgcctgctccgcaacacgctccgcatcctgcatcacacgctggataaatggatcgctgttcagcttttcggggtcaactactttgccgcccacgatgccgcgctcggcgagggtttcccgaatgacaacagggtcaatatcatcgaaattgtcgcgttccgcctcggtgtagaatttatcctcgcggatgagctgcgccagtcgccgctgcaccttcggccatgtcagttcggcggtttccgggcttccagcgcggacgataaagagattgttgccctccttgccgccgtactcgtgagcaagccatgcagcagtttctttttcacgtccgtgctgctgcatataccgcactacggcgtgtttgctctcgatatttctgttccatgcacggagcgcatcgtctatatcgtcctgcgagagcggtcgcagcagatcgtgaagccgctcataggttccctcaaaaacctcctgatgtaagcggctgcggaattctggaacatccgaaaatagccggataagctccatatcttttgaattgagaacggcacggcgcacagcggcattacactcgatttccgcattttcccggtcagagtgaccgcaggcgttgcgataggccgtatcctccgaaaccgctgccatcaccaccggcctgtaatgctccaaacgttcctgcaccgtgggctgaacttgctctgcggcggggtcgcggaacaccctcgtgccgtccgcgccgaactctgcttcataagcattgatggcggcttctgcttcatggtcaatagagcgcagcgtgtaaatgtggcgctcacccctaaagtctgacgcttcggcaatcgtcacgtcgtacttatcgcgcaatttctccacatacatctctaaattgttcgacggaaggccacacatttccacacggccagcgccggggatattgcgggtggtcaggttcatatccagcagctccgccgcctgttttgcgtcctcgccatacatttcaaagaaatcccccacctgaaacagcacgatgttgtccgggtgggattccttgatggcgttatagctgtcgtaggcggtgtttcgcgccacatcctgtgcctgcgccttatcataaagcgcctgttcgtctggtgtaaaatagcggttcatccgaatcagctcagagatacgcgaagcgaccttgttccaattcatctgaacatctgcacagcccgcttttttcaacgtgatgcctttgctgccgtgatcttcatagctgccgctttctctggatacggcatgggtatgcccgccgatgccgtactcctttttcagaaaatcggcattctccttgggggtgtgcgaagtctggaaaaacgcatagatgcgggcctttccaccctcaaagctgcttccgtttgcaagagaagccgaaatttcatcttcggtgataaacctgccggttgctggaatagcctccatatcggaacggaattcctttcgtggaagggacagatcttctaaacgtgtgagaagtgcctgcggccggtggtaatggaagcgcagcagcgcacggttttcgcggtaggcgtccatgaataccttgtattctgacaggagcctatcccggaacgccggattcagcagatcgtccgtcagacgctccgtttcctctggaaagctggtgctatggatattacccaagcaggacagataccccagcgactttgcttcatccgagaaatcgtgataaaggttccagacatccgcagcaatacccagccgctcatagcgcggggcttccgtgacctcaagattggtggcaaatgcgccgccgtccagaagttcctcaatatgctccgccgcatctgcccagcctatcacttgggcagaacgaagatagcgagaggtatctccggttgcaatatggataccatcgtctccgtaccatgcggaaaacctgccgttatccgtaatcaggccgttgccgccgtagtagagctttttgagaaataccgcgcgatcctctaaaggcttttgcttggagaattccgcagcaattttcatccgcgctgcatccgcattaccgctcgtgcgcaggatgtggtcaatatcatcctgagaaatgaacatagaaaaagcggagggtgttacactctccgcttctgcgatggattgaatttgttctgcctctgaggggaagaaggacatctgtgccccagcaggggcatcgaacatatttagctgaacaccagttccgtgaggatcgtttcctcggcctgcgctttcagcgtgttcatcagccctacccacttcatcgggtcgctggctttcagcgcttccgtcacgcccgctgacttcatcagctccggcatcatctgttccagtcggttgttcgctgcctcgtcgatctcccgcagatgggggtacagcttctcggacagcagcaggctgttccacagcaccggacgatgctccttcaggtaatccttccgcatcctgccgtacttgcccagcggggcttgcggctgctcggtcaggctcagatcgggaatcagataatccccgctgcgggtgtaggtcagttcgctcatggctttcgctcctttccgcgattttctcgcgctcgtaattcttgatggtgacttcgatctgccgcagcaccagctcgctggactggctgatggccgttccaagggcggcgacggtctgcggggtgttgaaatcaaagacgttcagaaaatcctcatgctcgaagtaatctcccggctgcatcccgcagcgggacagcagcgtataggtggtgctgacaacggcggcgttccgaaaagcggctccgatgttgaactcatcatagtcctccaaaaaggagccgtcaacgatgccgacaatatcgcgccgattgtcgtgccagtattcatctacaagctgcgccgccacacgctccaactgatcagcaagtccgttttcaccggaaacatcgaagcgctgttccagcgccgcagataccacctcacgatgctcttgccggtattcccaaagataagggcggcgagagttctcgccgccgctggtgtcggaaacatcaaatacatatcggagtttgggttggtcgctgctggtatccacaagggcgatgcccttgctgcctcgccgcacatagcggcgcatctgcttattccaaaggtcgtattccgcgcaggccgtggcttccgggcgctgggcgaaaatcatgagctgttcattgtaggggtacttatacagccttgcggcggtggtcagaaatgccgtccacttctggtagcttcccgtgatctgctccgccgtgcggtctgccatctgcgcatagagctgtactttactcggcatccatatcctccttttcaaaatcggggaacaggtcaagcgcgtcatattccgcgtcgctcatcctgcgcagctttgcgatggcgctgtccgtcagctcccgcagctccgtttcatccgcagcgaggtagccgcgcatttcctccagcgccgcgatcaagcccgtgcgggtgccggtgttgtagaggctcataagttggcgttcttcaaaggtgatgttcatatcaaagctccttttccgcgctctttttgagcgctgttttgtgtggacgttcttgggccggttggcttttgagctgctccagtacagatttcttcttttcccggtgtgccgcctctgccaaatccatcaaggagatggacataccggccttgacctgtgcttcaaggtcggcgacggtgggctgtttggggccgttgttgataatgccgtcgatcatgccgtaatcgtcctccatcgacatctcggcggctttcagataattctccggtttctgaaaggcgggcagctcctgaaatcccgtgctgtcacagtagtgataggataccttgccgtcctgtttcagcgcaacgatgtcgctgacggagaggctgtgtcccacaaaatcgccggggcgctcgtcgttgaaaatgtagtagaagttttcaaggattctgccggtatcatcgtccgggtacacctcacgggtatagacggcttcatagttggccgggtcaggcggcgcggccagactgccgaggttggcaaaacgcagctccaccggcgcatcccggcgcagttggtagatcgccatagaatcggtgggactgttcaaaaaacgctgctccacatcgcggggtgggatatggcccttgaccgcatcccaatccggtcttgtgacgccgaacattccgtcgtgcttgatgatgtcctcggcttcaaagaccatttcctcggtgttgccgggatggagcatataaaccgtgatgtcatgttccagaagctccactgcccgatccttggaaagcgggagcatatcgctatccagatacccatagctgcgcatatcatccaccgtcagcgtggggtcaggcatcgggacggcctgttccagctccgggagcatattatctgccgcatcggtgggaacagcgactgcgccggtgatctgttcaccggcaccgaggggcagctcgtttgcctcctgcaagtctttcaacagctccagcggcgcaaggcggatcggtgcggcattgccaatattgtggagcttgcaaattccaagcgccgctgtggacagttgctgttcggtgccatcgagtacgccgccatccagcacttttgcggaaccggcgtcatagatggtgtaatcaatgcctgtgtcgctgcgctgaacgtgaatgtatttgtcgttgtccaccatgtagagcttttccgcctctggcgcttccacacttggctgttccgcagcggccaaattctcccggtctatgccgcgctccttgcaaatctccgcaaagtgccggtcaatgtccgtaatcagctcggatgccgtcttattgatagtttccagactggctcgaagctctttcagctccttgccctttgaccatgtggcgatatagccgaagctgttctctcccgtttcaatgccgtaatactggcagaccgcataggaaatgctttcggcctcgacctcctcggtgttgcggctcttttcaccggggacaaggatcgtctcaccatcgtccgcaagctccgtcatgtgttcatagtcgtggagcttggcgtgggcaatctcatggacggcggcgcataccgtctgcacctcactcataccggcgcggatggtgatgctctgcgccttaatgctgaaaaagccgtccgtatcccgcgcaacgggctttatctccatcggaacgggagaagcacggcgcagcgcctccatgaaaacctcatactgctgcacattgccgctcagatcggcggcaagctggggcaagggctttcccgcagtctgcgacacgtcaaagacggataccaccttgaacatagggatacggatttccttttcctcaatgacggccttaccgtctgcgtccagtatcggcgcgttggtttcggggtcggtcttgatttcctcgacctttttcttatagggagtaggagcgatgatgcggatacctttttcgcctttcaggacgttcctgccgaactgatcgcgccacttgttgaagcccgccacatgggttgcgtcggggcgctgcatatagatgagcatggtattattgaccgagtagcggtgaaagcggctcatggtggcaaggtacttccggtacttatcgctctcgaacagctccttgatgccattttcgatgctgtcaacgatctcccgcatccggtctttgttggtttgtttttcagccatgatgatctcctttcagaaaaaatagcgcccctgcgcagaagaaaacacatcctgcacaggggcaattctccgcagatagaggccgtttttgcgcttgcggatagaatgacgcagccacttgcaatccggcatggaaaaagccttgcggcacggggctttcccagtctctatttgcggaggttccagtattgtttacgcttccgtttggcgtcctgctttcgacgctcctgcttggcgcaggcggggcaatatttggtgcgattggaggaagaatagaccggcttaccgcagacggcgcagcgctttcccggcctttcccgcatcacgtcggccagcaactcatggtcggcgggaagtaccgcgtttcggaaccagttgcacagcagcgagtaggaaataccctgtacgcagacgcaaggctctccatcatccagcgcgaggcagttgccgtgatcgtaattacagcagagcttccgaatgagcttcttggcgcggcggagctgcttgtgatccatacgcggcgcatcagccattgtcgaacaccagcttatagcccgtgtgctgcccatcatcctccagaagaacgacggcatcataggttttcccggttttttccgagtagcagcctttcagcggggcgcggccatttttcaaaagcgcagcggcaagagatttcgtcagcgcctttttcttggcggtgaaaaagcggctgtttttccagagaacaaaggaacaggtgcggttctcacagaaaaaacccttcggagatcccgtcacctcggctccgcagcggggacactggccgaccgcttcacgcccggaggggaacaggacttccgtaccggggatgggtttgtaggtctgcaccagctcatgtagcatggcggcaatcccatccatgaagctgtccggggcgatttcgccgcgctcgatctctttcaggcggtgttcccattcagcggtgagctgcggagactggagctgttcgggcagaacggtgataagcgccgtgccggtggaggtgggcagcagatttgtgatcttcttggacttcctgcgctccacaaaaccggaggacaccagcttttcaatgataccggaacgggtcgccggggtgccaatgcccttgcgctcggcatcatctggcatatcctccttgcccgcgttctccatcgcagccagcagcgtatcctcggtgaaatgcttgggcggcgtggtttttccggtcttgaccgatgcggcagatacggaaagcgtctgttgctccgtcaccaccggcagcgcgggcgctgcctctgcctgctcctgctcatagcgcttccagccgggtgcaaggacggttttgcccttggcggtgaagctctgaccggcacagtccaccgtaatgaccgtttctgcgtagcgatgtggttcatccaccgcacgaagcaagccccttgccgccagcttcagcacctcgcgttcgcccagcggcagagaggctatatctaccttttccgcgctgatggtgggaacaatggcgtggtgatcggtgacttttttactgctgcatacctgcttggcgcagatggtcggcggcttctccatgccgcagacagcggcagcggcggcgacaaggccggggacgctgccctccatatcgtcggtcaggaagcggctgtcggtgcgcgggtaggtacagagcttcttttcatagagcgcttggagatagtcgagggtctgctgagaggtgtagccgagaacgcggttggcgtcgcgctggagggaggtcaaatcgtagagcgcgggcgctttctcagacttttccttgcgctccacgcttttgacggttactgccttgcccttgcaggcgttggcgatggcgtcggcatcctttctgtccttcattcggcctgtcgtggcgggaaagccgcaatcgagctggacggtgtagaacggctctgccacaaatgcggagatctccgcctcgcgctgtaccagcagcgccagcgtgggcgacatgacgcgcccgatgttcaatgtgcggccatacgtcagggagaaataccgcgtggcgttgataccaaccagccaatcagccttggcgcggcacagggcagattgatgcaggccgtcatagtcgcgcccagacctaagctgctggaagccgctgcggatggcatcatcctccattgaagaaatccaaagccgcagaatcggcttggagcatcccgcaaggcagtaaaccgtgcggaagatcagctcaccctcgcgcccagcgtcgcaggcgttgaccacctctgccacatcctcccggcgcatcagctcccgcagaatgtcaaactgcttctgcttttcagagcggacgatgaagcggaacgaggtaggaatgatgggcagcgccgccagcgtccatttggcatcatcggcattgtaaacggcggcgtcggccagctctgccagatgcccgaagcaccacgacacgatgtacccgccgccctccagatacccgtcataccgtgattttgcacccagcacggcggcgatgctctgcgccacggatggcttttcggcaatcacaaggcgcatggtgcagcctccattctctttacgtcacggtagcaggggcgaacgcagctctgcccgaagcgcttacagccatagcagaagtgttccttggcagcggcgggagggctgtcctcccgcgctgctttcggcttctgcatcatcaggcgttccagcggattgttggtgaaatatctcatgcgtctgtatcctccgtagtatcctgttccggttcgtcctcatacggctcaaactcgtattcgtcctcatcctcaccgtagtcataatcgtccagatcggcgctgcccttggtctgcggcttggcctttttctgcttgaagatgtagaacgcggcaccgccgcccagcgcgacgatcagcagaacgacaaggatgccgcccacgccgctctttttctccggttcctcggcggcgggttctgtcggctcagcggggacttctggctttgcctccttgcccacgcactcggtcatgttgaccgcgcagacggggcaggatgtattgaccgtaccggccacgcatttggtggtgcaggagcaagtggcgggcgtttcttcctcgccggtcagcaccatcaggtcagcctcatccacctgatttaagaagtggacggtttcttcgccctcatcgtcacggtcaataatcatgtaaaacacattgccgttcttgctttccagcgtaatgaactgttttcctgccttggtgctggagccaatatcgtcgatcagcgtcagattgccgtccggtgtcagcgcgtcgctgccgcccgtcatgctgccgacaaggagctgccagaggtcggccagctctttttcatcaaacggaagcgtaatgccgccgatactcacggtactgtcggcggcgtcggtgacggtcagatagctgccgtacacatagcccacacgggcgggcagcaggatttttacccaatcgccgtccctgccaatcacatcgaccaccgtgccgttggggagctgcgtaaacgcggtgttgtccagtcccgcgccggtgcggacgttcaggttgccgccgttggtcgtgaccgtgccgatctgttttgtttcctgtgtgtctgcggcgctgctttcggcggtgggcagcgcatcatcaggataatcaccgccgctggcaaaggcagaaacggggagaatcccgatacacaggagcatcagcagcagactgataaaaatgcgcggtgtgttcttagtcatggttcaacgcctccttttccgaagtggccggtgcaggcgcggcctgcatacggcggaacagctcggcaaactgctccatcgtcatgccgttctcacgcaccatgccgatgatgtcggtgtcctccaactcacgaatctgcttttccagctcgcggttgcggccttgcagatcggaaattttgcctttgttcttctccagctctccacggagcttcataattttcggattcatattgttcactctcctttacggcaagcgcccatagcggtagaaatgggactgccaatagcttgaatttaagttcgcataagagatcgggtcgccacagtggatcatcatattgttgccaacatagatacccacatggctgacacctggggtatcatacgttccggtgaaaaacaccagatcgcccggcttgacgttggcagaggatacgggcgtacagatattgcaaagcccctgcgcgcccagtctgcccacatcccaaccggaatgattgatgacccaactgacgaagcccgaacagtcaaacgaggtggaggggctgctgccgccccaaacgtaggggtagccgagatacttttccgcttccttgatgatagcggcgaatacctcatcgtccagcgcctccgggggaatgtcgtagtcggtatagctgccctccacatacttgccgatgtagcctgaaccggggaacaggtcgggacggttgccgagggtggccatataggtggcgtacattccgagctgttcttcgctcataatgtagacgggaacatgggagagattgaagttttccagcgtgaccgtgcagatgtagtagtcatacggcacctgataggtgtccgtatgggtgttgccgtccgcgtctgtccatgtgtcggtttctgtgcggtagcgggtttccaccaccacatcctcggtcaaaatgtactggcggtcaaagagcatctggagcgtaccctgcacctcatccagcgtccattccccttgatgcagcgccgtaatcatggaaatgagtacataggggtcatgctcgatggtgtctagatcaaagtggtactcatcgtagtcatgggtgctttcgtaggtgtcgaggtagcgctgaagctctgcctccatttcgcaatactgcgcttccgcacccagcatatcggtgtcctgcgacggataggtactggccgcgatcccggagccgacgccatccattatcaccgagcaggaggacaggccgttgagcagaaatgccagcatcagcagaattgcggcggcaatggcaaagccgcgccggtgttcccacacatatttgcccgctttctcagccttttcagcggcttttttcgcggccttggcggtattctctgccgcctttgccgtagtctgcgccgcctgattgtgcttggcagcggcatactgctttttgatggcctgcttctgctgccacttggaaacgggattgctggtggggctgtcgatctctgctttcttctggagcgcgtcaagattggctcgttccagctttttctctgcacggatggcagcacgataaggcttgagctgatgggcgcggtgggcagactgcaccagccgcccgccgctctccacggcttgctctaccttgtgcgcggcctctacgcctacattgtcatcctcgctctgccgcacctcccggtgaacctgagagagaacaaagttggcgggggcatcccgcacggcatgggtcagctttgagggcggctttttcttatccacttcctcaaaacggagctgcgttttgaccttgccggtggccggatcaaagccgcgttcccttttgaccacggttttcttggggattttcgcctgcgccttatccgccttggcctccgcttttttcacccgcttgatgggcttttccagcttcggctcggcaagatcggcgtcggaaaactgcaaacgcggttctcttttcatgccgacgccacctcttgcggtttggtggtcatgacgcggtacagctcggtgtccttcgggaagtggtcaatgaagggcaggatcgtgttgccgtagaacagcagcccctcgccctcgccggagtgggtcacataagaaagctgatgcggcgaaatgttgagctgctttgcgagaatctgccggtcgccagcggcctgattgagcatatagatgaaatcgctgttctcaaaaatgttctcaacctcgcggctggataacaggtctttgacattttgcgtgatcccggtggggatgccgccccatttgcgatagcgcttccaaatctcgacactgtacgaggccgtctgttcctccttcaagagaagatggaactcgtcaagatagtagcgggtcgttttatgggcggcgcggttgatggtcacacggttccacacctgatcctgcaccaccagcatcccgatttttttgagctgcttgcccagttccttgatgtcgtagcagacgatgcggctattcacatccacgttcgtgtgatggttgaacacattcagcgagccggtgacgtagatttccaaagcagtggcgatgtactgcgcttctttttcatcctgcgcacggagggcgttatacaagtcctccagcagcggcatattctccggcttcgggtcattgaggtagtcccggtagacgatgcgaacgcagcggtcgatgatggtcttttccacaggggcaagcccatccttgcctccgacgatcaactcgcacagcgacagaatgaagtcggatttcaggctcagcgggttatcatcgtcgctgtaatccagattcaagtccatcggattgatgtagcagggcgaaccgtcgtagcccttgccggtgggcgacagcttaatgacctgaccgtgcagacgctccaccagcggcgtatattcgccctccgggtcacagatgatgatgtcatccttggggcagatgagaaacgcattggtgatctcacgttttgccgaaaacgacttgccgctgccgggagtgcctaaaatcagaccgttgggatttttcagcagcttccggtctaccatgatgaggttgttggaaagggcgttgatgccgtagtacagcgcctccgaaccgttctggaacagctcctgcgtggtgaaggggacgaagatcgctacgctggaggtggtcaagccccgctgaatctcgatctgattcagccccagcgggagactgctcatcagtccttcctcctgctggaagtccagccgggtcagcgcgcagttatatttctgcgcgatgctggaggtctggaagatgttgttgtcgagctgccggggcgtgtccgctgtgttgagaatgaggaaggtcagcaggaacattcgctcgttgcgggactgcaaatcctgcaacagctttttggcctctgcgccgtaggtagcaaggtcgcttggaatgatgtccatgtcgtacccggcgcggacggcttttttctgttcttcgattttggatttgtcgagatcggtgatcttgcgcttgacggtcttgatggcgttgacctgatccacagactgcacatggagattgacgaggacgctgctctccatatccagaaaatccgccagcatccggtcgttcagctccggtgccagaatctgcacgaagctgaccgcgcccagctttttgcccatacgaaactgcctgccggtcttgaactcaaaggagctgggcgcgataaagtccttagtggacagcccagagggagccagccagtcccacgaaaagcggaacggttcctgctcgtccatccgcagaatgtcgtgcatgacgtgcaggcgctcaaagccgttcagcggcgcagccacaacgcccagccgcttgaagttgttcaggaggtcggtttcgatgcgctccaaacggggcttggcagcgcggaggttgtcggcctcaacgccgaacgtgagatacttggtcttaatgaggccgttgttgccgcgggcaagctgattttgcagcataccggcgtactcggtgcggatgccgtcaaactcgtccccgcagggcggaatggaaatgctccgtgcaaaggtttcctgcgaagccgagaggttcacaaaggaaagctggaattgcacggagctgtcaaagtagttcaggaaatcgcaccacgcctcaaagatggcggtcttgtcctcgttctgcgagagctggtagttgatgtcctgatactggatcgttttggtgtagcgcgtgtcggtcacacggcaaataccgtccggccacatacgctgatacgggatgctgtcctgcgccgatttttctttcttatccgttcggttcgctcttgcgatggcggcttcgatctgttttcgttcggcgcgggtcagctttttcttttcggacaatttgatacacctcccggtctaactggttttgccgctccaaaacggcatagaaattgttggtcttatacgggcgctgcttcggcctctggaaacacacgcggtagatgttgcggatgacgacctccaacggctgaccgttcttttcatacatggcgaacagcatagccgggatcatcaccaccatcatcaccatggcggcggggctggtgccgatgctgcccttgagcaagaagaaaagcggtacgccgatgagcgcgccgcttccgaagcagatgagctgtcgtttcgtgaggttgaataataccttggtcttaactttggttaagtcctttgggacgttgacataggccatagaaatccccctttacaagagcttttcatatcgaagtttcatctgcgccgggtacaaagcggaggcgggcttacggctgcctgtccagcatttgccgcctgccaagcctgcgcagctccaaccagcggcgcggagactgctgccgctctcgctatccagcgtataggtgatgatcttgcggtatcccattgcctttgccgcccgcgcggatgcggcataaaggatgctacaagcgttcttctcaccggtggtgcaaagacgattgacctccaatgtccagccatcatccagataccggctcacaggacggcctacgattgcaacaccgacaagctctccatccttggcacagccgatggaaaacttatgtccagcagttgccttatggtgccggtgatgcgcattgacaaatgcgttcgctgttgcaagcgcgacgggcgtgagtgtcagcatggtatcacccccgttaatgtgcattgaacacggacttggcaaggctgctcgttttgaacaggcagaagcacagcagcaccgtgtagcccatgcaagtccagatggcgtagatgatgtcatccacaagcgcgatattctgcaccagaaccgcgtaaatggcaacgcagacgataatcaaaaacgcttggaagcccagcgccagcagggaacggatgtaattctgccccatgccgccccattccttgcccatcatggtcgccattgggatgggggcaacagaggtgacgagatatatttcaatcattcttccgaatgtgataatgaaaatgcagatggtcagcgcccacatggtaatgccaacgaacagtgactggaaccacaggccgaacagtggccccagctccatttccatcagccgatcctcaatgcccaccatgacgcttgaaatgttgatgctggtgtcgccgataatcagcccggaggcgctggcaacgacgctttgggcggcatcgaacacgcccatcacaatcgtccatgtgtttgttacaatcaggacagcggcagcggacttgaacgcccacttgaagaatatccatgtgtccatgtcgttgaggttatttttgtcggtaatgagctggatcagttccagcgtcatcacaaaggcgagaattgcgcctgcgatggggacgatcacggtttccgacaggttttgtatcatgctgaaaatgctgccgttccatgcctgcggcgataagcccacctgaccggagatctcggcaaccttttgattggttgcatcgaacatcccggacagattgctcacgataccgccgatgagcatttctttcagccattccgtgatcttatcccataagaaatccatagggttgccctcctttcgggaggatgccgccagaaagcggcaccctccgtggatttatgggaagcaaacgagctgccgattagccgaacagaccggacagcagcggcacgagggtaatgccgattagcgccacgccgccgcccgccataagctgcttcatgccctgagattttgctaatgtgtgataaagaagcattagaagtgtaaaaaattttgccgttcctatccggcacttggccattgtgtcggataggtcgggcggttattcgggcaagtcaatcttgccgacaaagctgtaataaatctcaatgtcctgcctgcgggtgccgttctcgtcgtaactgcactcatgcaccacgattttctctaccatttcccgcaacagggtgggggtcagttcttcaaaggcaaggtgcttgcggacaatgcccatgaatttctcggcgttgacggtggcggcctgcgacttgtccagttcagcttgcagggctgcggctctctttttcagttcagcttgctcggcttcataatcagccgacagttccatgaaacgctcgtcgctgattttgccgtttacattgtcctcatacagccgcttgataatccggctcacttcggcaatgcgttcctgtgcctgttcaagctgcttggtggctgcggcggtctttcgcttgccgccgatctcgttctgctggacaagcagtttcacaaaccggctctcatgcttggctgcgtattcggtcacttgccgaagatttgccaggacaccggcggtcaacaggtcggtgcggataaagtgcgccgtacagtcgcgggtgcgcttcttgtagctgccgcagatgtaacagtcctgcttgcggtctttgttctgataccgctgctgatacagcacatggccgcagtcggcgcagaataaaatcccagagaacagccccacttcatcatagcggttcgggcgtttgcgctgcttgcgtaactcctgcacacgctcccatgtttccatgtcgatcagcggctcatggtggttctcaaaaatggcctgcttctcaatggggttctctacgctgtgcttgaccttgtaagagggcttttccgtcttgaagtttaccagacagccggtgtactcccgattttcaaggatatgcacgacggtgtttgtcgcccacttgcactcatagccggggtggtaacggcgggtgctgcctgtccgctgatattccagcgtccccggcgtggggatttgctgctccgtcagcatacgggcaatcttggtcgggccgttcccggcaaggcaaagctggtaaatctgctgtaccaccggggcggcttcctcgtctatgatgaagttttcgtcctcgtccatcacatagccgtaaaccggcttgctggtaacgggcttgccgctcatgccttttgacctttttactgccttgattttcttgctcgtatctctcaccagccattcgttgaacagatttcgcagcggggtaaaatcgttgtccatgccgccgtttgcgctgtccacattatcgttgacagcgataaaacgcacacccttttgagggaacagcatttccgtgtaaaaccccacttgcaggtagtttcgccccagccttgacatatccttgacgataacggttcccacttttccggcttcaatgtctgcaagcatagactgaaagcccggtctttggaaatttgccccggaataaccgtcgtcggtgtaccagcgcagattggtaaagccgttctgttttgcgtaggcttcgagtatccttttttggttcgatatggaattgctctctccttgcagttcatcgtctttggataatctcggataaagggcggtaatcaggttttgggtggcttgtcttaacataaaatcctccgtttccgacagccagccccactattccgtatttttatcataccacatggggcggctgtctgtatagcggcaaaagtgtaaaatctgcttctttatagtttataaaaaagagcgttcttttcatagggattatcatgaaaaacggtaattgaaaatccctttacttcatgctataatacgaaaagcgttaccagcgacgataatgcgggattttgtctgcaattcattgaaggaggtacaggcatgaagtttgaaaaaattgattgtggcaacggaattgcggttgccgtatcaagtgacagcatgattattactgatgtcgattctgcgcttgatttgcttatgtctgccaaatacgaagcaggcacaaagtatattgtcgtggataaaaagaacatcattgaagatttcttcattttgagcagcggcttggcgggagaaattcttcaaaagtttatcaattacggtggaaaaatcgctatatacggggatttttcacattacaccagcaagccgctgaaagactttatctttgaaagcaataaagggaaagatgtgttctttgttgcaacaaaggaagaagcaattcaaaaataagtcaaagcatttagtggataaaatccccatatcggatagttgtgtattaacccaacgcgaaagcggccatgtcaaagcatggccgctttttccatgcccccggctcatgccggataagtcggcttctgtgtagcagcggcttcggcttgcagcactttttccattttgtcgatggcagtttcggtgctgtcctgcttgaaatagccggacaccacaaggacagagttgcccatgcggattttcgtcacgcagtcggggcggcggggattggtttttgtggtctgttcgtaatctgccataggctactcctttcactcattcatcagatttttcagccgttccagcttggcttgtgcggtttccctgcggaagttgccgcccgtaaaacggacaggggcgcacatttccagcagccggtcatagatacgggcataggcggtgtcggttgggttctggatttgctgcaaggtcaggttggtggtgacgatcagcggcctgcggctgcggtatcggctgtctatcacgctgtaaacctgttccagcccgtaggcggtgtcacgctccatgccaaaatcatcaaggataagcagcggatagcggcaaagccgggaaatgtattcgttcctgccctcgaagctggcggcaaggtcattgaggatagcggcaaagttcgtcatgcggacagggattttctgctccatcagggcgtttgcgatacagcccgcaaggtagcttttgccggttcccacaccgccccaaaagagataaccgatgttctcggcctgcatggtgtcccaatgctccgcatagaaccgggcaacggcggtctgggggttcctgccgttgtcgttttcaaaagtccagtcccgcatggcggtatcggaaaatccccggcgtttcaagtcctctacggtgtcaaggtgtctgcgctgctgttcggcggcttcacgctcaatccgctgcgccctctggcagtcgcactctgccgggtggcggtcaagcccgaaaagcgtcttgccctctgggaaataggcttctttgggcttgcggcattttccgcagtacagcaaaccgtcctcgcctgtgtagtcgccgctgtccggctcggtatccggcagcagattgatattctcgattttgttcataaactttctccctccttgcaggtgtagtccgggacaccctgtttcggggcgtcctttttgtcattctctgcccatatccgcagggcggcggcatagttctggtaggttctcccgttggcggcaaggtagcggctcatttcctcaatgagccgttccagtctgtccgggaactcggctttcagttctgcatactcggcttcggtcagaaaaacattctcatatctgccaaacggtttgtgcggctctccactcactcccattgtttggttttctatcaggttgtttatagtaaggttgttaggggtcggttttccgaccgtcataaggtcgcttttccgaccatcagtaggtcggttttccgcacttatgagggtcgcttttccgactgtcatagggtcggaaatccgaactaatggcggcagcttcacatacaggcggttggctgcggaaaatcccgcccgtttccgttccagaagtccggctgcgtccagttcgttcaaggcggctttgatggcggtctgccccttatccagcatttcggcaatctccgctatgggatagacaatgaatgtcctgccctgatcgtcctgccagccgttccgctgtgacagggtggtgcggtctaacagcagcgcatagagcagcttggcggtctgggaaatgtccattttcagcaggaaccggggatatggcaggtagggcggcaagcctgtgtccagccctacataaatggtttcctgcgtgttgtccggcttcatggcttcgcccgcttggagcgaaacggcgggcactcgatgatcatagcccggaaactctgcttgcaggtgcggcggcacttgcggcaaagaggattgtaggtgatacggttgcgctcattgaggaagaacgcccattcttccttgcgcttcttgctcattctcggcatggcggctcctttctgccgtttctatcgatgtaaccggataggcggcgtttggtgtatgatttcggtgtcattttcggggattttcctctctgtatgccccttgaaaaaggcaggtggtattgcggatagggtcagatatagggaacgcttttgtgcggtttcggtatcatttcggggtggagttcagtggtcaatttcccatagcaaaggggtgtccaaaatggaaccccctttccgggtaggggtggaacaaaacggaacacccttaccgctcccaatcccgacgcacctcttttgtccgttcctgccggagcatggcggcaaggttggatttgaccttttgcagctcggcggctctggctttctgctcccggtactcggtgtaaatcccgtttttctcggaaatcagggcttcattttccgcttgcagcttggaaacggcgggcagcttctttaagccctgttgccgaaaataccgcaccgccgcttcatacagcgtcaggtctgcatgaaacgcttcccggtatcgttccggcttcttggcagttttcagcccgtcatgggcgggcttggttctgcggtaaacgctgatctggtgcatgagttccttgttggcggtgattctggattccagttctttcagcttttctccggcggcgtgctgcccggaaatggcggcttccaaagctgtgtccacttcttcggggctggcaaaaccatgctcggaaaggaaattcatggtctttgccatctgtttgaggttaaaggtttttgcccaacgctcataaccgataccttttccctcggctcgcttggcggctatatctacaagccgctgcgggctgtcagggttcggggtgatttgggcgggttttgtccgctgtatgcccttagtaagctgcggctggtgttcctgtctgtcctgcatctttgcggctgctctatgggcgttctgctggaaaacagcaaggacagcggccttgtcgaagtccgtccccagcttccgggcggtgatgggctttgttctgtccggcgtgagataggacagccgcccccggctctccttaacggtcacgccctcccgcaacaggagagcggaaaactcgtcaaagctggcggcggtggcaagggcttggcgtatggtctgccgcaaacggcctttgtcggtttcaaacttggtctgtcggggtgcgataccctcggcaagcagcacagcgttttccttgtccagcttggcttgccccttgcgcttcgcccagtattcacgctcggtcactttgtttcggctgccgttcaagaggtcgatctggtaaagcccctcccggtggcacatctccatgacttcgctgcggaaataccgcatggcggctgcggtacagcggtgcttgttcccggctctggtgtcgcttgccctgtccatgtagggcttgcgctccacctcggcaatccgcagactgttgatgacaatatgcacatggatattgccgctatggttgtgcccgtccgggtgggtacagacaagggcttggtgtccgggaaaatgctctttgcagtaggccagccccaacgcctgcgcccggtctacggtcaggccattgtcggctgcgtcccgtgggtcaaagctgatgatatagtggtggctcttgatgtcctcccgtttgctgttcttgccgtaccgcagatttgcccggatacatgacagggcaaaatcttcctccccgcagttcagcgtgtccagccggtagtcctgccggggaatgagccgcccggcttcatcaagggtgggtttcatggtaaactcgtcatgctcaaaggtgagataggcttcggcggctccgtagtcggcatttttagagctgatatgcttgatcgttgccataggcttcacctatcactttcagcacctcgaatttgagggcggcaaggtcggaaacagcggctctcacctcactggacagggcgttgtagggtgcgccgtattcgttgagataccgggcgatctggttcaggttgctgccgattttcccgtactgcgccacaagggaagatatggcggtgagcatttcttcgctgtgggcagtcacccggataacaggagaaatccggctgtaaaaaacggcttgccggatatactcggactggctcatggagagggcggcgcatttgtcctcaaaggctctgcgctcgtcctcggtcagacgggtcttgacaacacatttccgcttgggggtgttgtaggttttgtgtggcatggtggctcaactcctttcaaactgcaacggacaatttttatctaaaacacaagtattggggcaagttttttcagcggcgcaagccgcaaaaggcgggtttggggtggcaaccccaacaagtatctgaccgggggacaaatgagcgaaaagcgaaatttggtacactggtcgatacttgctctccgtgactgcaaactttctctcacttccgtccgccacttttttggaaaactgcaaccacaaaagtttgtttctctttttctgctactactaatcctgtaaagggcattcctgcccgctttcgctaaaatgacaccggacgcagtggtttctacccggtgttggagaaatcctttctctttgccctctactacgggtaaatgctccaaatgccaaacaccagggcagaaaaattccctcctcgcttactactacaaccggcagggggcaaaatggccgggagcggagccggacaacaaaaaaagcagtaaatctttttcaagacttactgctttcgctggccgcgtcggtggcggctggtattcagtttttatgacttgtccggtggttcgtcaagccggaacttgaattgacagtcaattaaccgctgctttacatagtcctccacctcggcgttgacctgcccgttcacttttgagaaatagcggatatatccggcgtagtggagcaggacagcgttcacggcttctgggtcgccctcacgggctttgaggattgtttcataggggagaagtctactcataccggctcacccccatttcttcgcgtagccgctgcaaggcaagctggatatgccgccccgctgtgctgcgtgaccggccaatacacgcgccgatcacgcgctgcggctggcgcagaaagtaatagcgcaggatttcttcccgcgtctgctccggcaaaacagagatcgcgtcggcaagggcggcgttgcagagcaggacggtctgaccgcagacggtaaatgggtattcctcgtccggctccgacgcggcaaactggacaaacttctcgttcatcagatagtcaagggaaacttgccgttcccattgccgtttaagcttcaaaatcttgtccaaggcggcacagcggataacagtcttgcaaaaggcgttgtacctgcgctggatatattcttgataggctatctggtcggtcatggaaattcccctttctgaataatagtgcggggcggtggcacttcttgctgtcgccccttgattgcctaccagcaaaggcgggcggggctgtcaacggctgcgcatatgcgccgttcatcttgaccgttgactggctcggctgggtttgctatttacccgacaaacttgaatttattttaagctatcacgttttaccttcttaagccttactatcattaccataggaatttctttgttggttttaaaacattcttcataaaatccatcaatgacaaatccagctctaaaacaaaggttaaaaatatcttgtatggaacgatgataataaatctgctctttcggttgcccttcaatcgctatatcatagtaactgtgcggtgtcatatatttttcagtcaacgtgacaaaacaagggtgttgcgttgcaaagacaaaaattccgctttcctgcaacagttcataaacagccataagaagtggttcaatatccgtaatatccataattgccatattagaaactgctttcgtaaaggctcgatttctttttaattctaatatactttttctatcggtcgcatccgccacacaaaattcaatttgttttgcatattgtgattgccgtcttttagccaattctatcatttttttgctgtaatcaaaagcgacaaccgaagcgcctctttgtgcaagatacgaagaataatttccattgccacacgcaatatccaaaatgtaatccgcaggattaggagatagaagttccgttactttgggacgcactacctctctgtgaaattcattagattcgtcacccattgcattatcccaaaattgtgcgttctcctcccagatttttttactttcctctgttcccatgttctctcccactccccaaatttgcttttttgcttccattaaatcttccttactatattccattgttaccctccataacttctgattgttgccgtcttgacgattatgtatctttacattaccttctgaaacatatggcgcaccttgtccaggcggctgtttggacggcggggctggatgaccggctgaccgacagcggcctgatatcctttcagctctgtaaggcatacgctccgcccgttggtgtaaaaggccagatcagtacggtatgcctgtatacagcgggcgggaatctcgccagtaaagacaacttcatccttttttacctgggccgtttcgatggtggcacagtatttcggtgcatcatgataagccctggaaaggtattcctggggcgcatagaggatgaaggagagataaggttccagcagctgcgtccccgattccttcaatgcctgttccaatacaatcggggccaatgagcggaagtccgccggcgtgctgaccggactgtaataaagcccgtattcaaagcaaatcttacagtccgttacgttccagccgaacaagccctgctccagcccgtaacggataccatccctgacagcgttttgaaaactctggttcaagtatcccagcgaaacccggctctcgtattgtacaccggagccaagcgagagtggtgtaacagacagtcctatggatgcccaaaacgggttgggcggcacctcgatatggatggtgtggctggctgctttgagcggccgctccatataaatgacggagggttcctttaccactgtttcaagcttgtatttttccgacagcaaagcggaaacaacctccaactgcacccggcccaaaaaagaaagaatgatctcatgggtgatggaatccacttcgcaacgcaaaagcgggtcagtatccgcaagttgcgtaagagcgtccagcagccgttctctttgcgctgccgttttcggcgcaatcgtcgtccgcagcatggggagggggtcctcgcgccaccttttacgagggagccgggtttggtcccctaatacatcgtttaacctcacgctgtcgctgggaaggataacaatttcaccctgataagcggtgtctgtccgaacaatttcccctttggatggaatacgcatctctgtgattttcagcttttctctcccggccagggccaccgtatcccgcaggcgcagcgttccgctgtataaccgtagatagacacgccgctggccgcaatcggtgtactcaaccttgaaaacgctgccgcatagggcggcgcccccctgttcccccatcggttggaacagccctgtcaccgcatccatcaacggttgaatgccaaggccatttttggcgctgccatgatagactgggaacagggaggcgtcttgaacccgctgctgttcctcccgcgcaagtttttcccggctgattggttctcctgcgatatacttttccaataattcatcgttattttcgatgaccgcatcccatgcttctatgtcggtattttcctccaggactatttccggggacagcgacaccgtctgcttgatgataatatcggcggagagcttatcccgaacagactgaaccacgctctgcaaatcaacgccagcctggtcgatcttgttgataaagataacggtgggaatgttcattttccgcagggcatggaacagaatacgggtctgggcctgcacgccatctttagcggagatcaccaagatggccccatctaaaacagccaaagagcggtacacctccgccaaaaaatccatgtggccgggcgtatccacaatgttaactttacatctgtgccactggaaggaagtgactgccgcttgaatggtaatcccacgctgccgctccaaaaacatggtgtccgtcctcgttgtccctttttcgacgctccccggttctgaaatggctccgctggcatatagcaggctctccgtcaaggtcgtctttccagcgtctacatgggcaagaattccaatattgattattttcatgtgattgtcctccctttacagccccaaagggcataaaaatccccagcagtaaaatacttttaccactggggattataagttgcggacatacacatatacagcatacacctgtttgtgattgctgtttttggggatatgtcaaaattgataaggcaaaagtattcttaaattgggtacaaaaaactaagcccctacaaaaggagctatcataatcctttgttcccactatttgattatagttttatttaagaataccttgccgcatattttttactccttttctggattaaatcattgtatcacatcagttttaggaaagcaagtacctaaaagaaatttttcttccccttatatgtaacaatcataccggcttcctagcgttcagaatgttttctgctgtctgctgtggtgtttggttggaattgtccaaccaaaagccgatccgtggtgttgtctgcattttactaaatacaaattcaatgtatacagaaagatataaggagtgggagggattccgccgtagttggcattgtaggaaaatccaaaagtttagattttcccacaatgcttatcttttggtctttggttcggaatagtgtagtgctggcggtctatctcttgttttcggttgcttgcttccttaccgtacatgagcattggcgccgggattgtcattaccataaccttccagcagattgatcgcaccccaaatgccgaggccagcgcccagcgccacaacgagggtctgaagaacaccaacagcagaattaaagaaagccataaatagtacctccgaaaaatatgttttttagattttggagggtacatttctcccacgaagtttcatcgagtcgttgtcaaattagactgccgccgtcaggcgacaggttcaccggaaaggtctgcctgatacacctcaactgcatcatccggcttgagcttgaggcgatgggacagaaaacgctctatgtcaaaggcgtatttcttgtcataatccgctgtgtagcggtagaggggatgctttgtgagatcatatttgttggacagaaacgggcggacgccgcgaagctgcaagatgcacttgccgccatccagcacggcaagctcatccacgctcatcagctccttgcccaatttctgatagttcagcgaatgggaaacctcgcggccacggctctcgccggtgttatagtggagtagggaggcaccgccttgccatattactatggtaggttcgcaccaccctctccgggaaccggacttacatctctcaatgtatccggctctgttatcgttcggtcagcagttactcactggttgtggattgcaacatggcattttttgcacacaaccagcgttttacgccgttttgcaatcattgcaacctcccatgcctgcttgcccttaaggtttttgagcttgttgacatggtgaacttcgtaacaatcgctctcggtcgtaccgcatagctcacagacctttgctttcaatctctgctccaaggctgttcgggaatatccgtactccaccgcagcattgcatacgatgtccgtcggattggccttatccttgcaatcggagtattttgcaaaatagcatcgtttttgccccgttttggtttcgtaggggattccccattctccgtagtggtctttgaatttctcaaccaccttggctatggtgcatttatgcttacttgcgagggttttgaggcaactgtattccatgagataggaaaagtagcacagtttataaaaattgctggcaattccatagtagttgcagattccccgcagttccgcattgtaggcagaaacgatttccaaatctgtgagtcgcaaaagagatttacggcggacaggcatgagtttcccatccggtttctgtatcgcaatttccttggcgaaaatgaagctgtgaatcttatcatcgaatgggatagacagttcacaggaattgttgagggtgcgttttgtctttttgcctggcccaccatgcttgataatgctgcttctgcgaacacgaacatcataccccaaaaatcttgccctttcgctgctatgagtgatgagtgttttttcttcgctgagttccatctttaaggtttcacggataaactcagaaagtttactctttatccactggcagtcctcttgacttcctttcacaccgagaataaagtcatccgcatagcggatatacttgatgcacttttttgtctgagctgtacagggcattttcagcatgagcttccgcttttcgttgtattcggaaagcagttgttctctttctgccccggtgcgtctgccgatgtgataggaaagtttctggaggtcattgcttaggaggcgatattctgtcctgacaggttcttgcccatgggtatcaaattcgcttttcagcttcattacaaatttgtccagctcatgcagatagatgttagcaaggagcggagaaatgataccgccctgtggagtaccactgtaggttttgtgatatttccaatcctccaaatatccagcctttagaaatttgtaaatcagctttatcaaccgggcatccttgattttactatgaatcaagcctacaagaacgctgtggtcgatattgtcaaagcaccctttgatgtcaccctccacgaaccaacgcataccattgaactccatttttaaggatttcagtgcggtatggcagctccttttgggtctgaatccatgagaaactggcaagaaaacaggctcatacaccgcttcgagaaccatccgcagaacttcctgtaccagcttatctgtgaatgtcgggattcccagaggtcgctttttcttgggattgttcttcttctggatataggttcttctggcgggtgtgggctggtaggtttcatcagcgagcctttggatgatatttgcgattttggcttcgctgaatccatctgccgtgtcatcgtttgcacccttagttgcggcaccactgttggcatacagatttttatatgccagaaaatacaggtctggcctcagcatatagcgatgcagtctggtaaaaatttcatctttatttgcgagtgagtttctactgattcttgctaaaatttcggttgttggttgcattttgaggttttcctccctaatcaacttttcttttagtacacaataactacgccccttcgccatgtgagggtcattacccctctcggactactacgggcgttccgtgcccatgcaggattttcaggctctacagccatagccgaattttcacctccttcggttggcgttcctgtttagggcatccccagttagcgttgagcataggcaaatgtggattgtcggtctccgctttcgtttccttgccataggttctcctacagattgcacaccgtttttgataaccgattgattgacacctataaccaatcgccagtgtgccagaggttacagatactttcctccgcctgaccgataacagaaattagaaacttgcgttcagtaaacccaacttaagcctcatatccacttaacattgcagttcagtcgcaccaagttatctttaggtgacttactgctttcctgccgtgctgtgttcccgtttcagctttcgcctttcggttaggcaggttgtttcccgtgttatcttacggggtagtgccttacactactttgctcaacgccctatctgggcgcacagtatcaatggtttccttgcccagcagcttggacacatactcatgggtggattgctcgttgccgcccatatacagaaattcatcgcaatttcccacaaggctctcccactgcttttcaaaaagagccttgagctgggcgaggttctggataatgatgctcacggagatttcacggctccgcatggtggcaagcagtttgtcaaactcatcaggcagtgcgacattggcgaactcgtccatgacgaaatgcacatggacgggcagcctgccgccgtgtaccacatccgcctgatagtagagctgttggaacagttgggtgtagagtaggccgacaatgaagttaaaactggagtcattgtcggggatcacggcaaagatggccgtctttttttcacctaagctccacaattccatctcgtccgtctgcgtcatgccggccagcgattccagattgaacttctccagccgggacaccagcgtgatctggatggacttcagggtcttgccgctgccggagcggtaattgcggtaatatttcagggcgatatgctccgggtcccgcatttccaggcggtcaaagagttcatccaacggggattggtaggtgtcatcatcctcccggacctcgccagcccggatcatttccatgaccatggagaagttccgttcttcgggcggagcttcgtagtggagatagaacaccagcgccagcaagagcatctgcgctgcctgatcccagaaggggtcctgtgactgtgcgcctttgggcgtggtgttcttgaacaggttggtcacaagccgctgaatgtcgttgtcgttgcggagataggcaaaagggttgtagcagtggcttttctccatattgattaggtcaagcaccttgatgtcgtagccgtttgcttcaagcagtcccccggtgtcgcgcaagatttcacctttgcagtccagtatgataaggctggtattggcgttcataatgttgggcttggcgtagaacctggtcttgcccgcgccgctgccgcccaccaccaggacattcagattgcgccggtgtctgcggccatccagtccaatggcgacattctgtgtgaggattttgttcgcggtcagctccttatccgcatatttcctgttgatcgctctggggtcgccccacttggcgctgccgtgttcctcccgcctgcggtagttgcggtcggtggagaggtagacgccaatccccagcccatagcacaacaaaaaaatgaggacagttttcaagctgtcctcacaccatacaatgtgaaacggatggtccagcgcggccccgccgtaccgcaccagccagaccagtccgccgcccatatagggggccagcagcagggccagccagaccacaggaatgacgccgcaggcgtagagggtcaggtaggctttggagaacttatcttgcctcacggtcagccctccgtttctcccgtttcgtgggcgcgtctatgattttgagaatgagatcgtccacatcttcggtgggtttgccgtcccggatggcatcgttgcggaagtcagtcaggccccgcaccataagccgctgttcgtagtcattcagcgtgaccacacgcttctcatcacgcatagagcgccctccttatctcgcctcgtcatctcggttcttctgcgccttttcctgggcggcaaagagtcggttcatatcggcggagatactcccggccacatcccgtatgacacccgcctcagcccggagcgccctggcgtccatcccggcatagctctccggcaggcgttcaaaggaaaagccctctaccgatacgccatttcttttgcacagcatataagacacgctgtacgccgtaaaatcggggctttcacaggtaatcccatcacggtccatgtgggcgcgggcaagctcctgggccagcccccggaagatggtaggggcgtccaacccctggcggacatagacggtatgctcctggggatgataggccacattgacgccctccggcagttcgttggagatagcaaaccggcagggggcatcgttcatcagggccttcagcagcaggcgttcatcccggaccgtggtgggggcggggcgctgggcggccctggtctgggaaatgtcaaagaccttccgcacattgtaggacacgcccacgctgccatcgtcccgctggtactccttacccggttccagaatggtgatagcatccgctcctcgccggacatacacgccgttggctttccaactgtcgaagtcggccagtttggtggcctccgggcactgggccgcgatcaggatggcgttgctcacggagtagaggtcaaaccgggcctgcacatccaggtaggcttggaacagcccgccctctctgcccatatcctgcacatagctgtcgatcatggcgtagacgccctcgcgctccgcctgctttcgcgccgcccaaaccgtcttgtcaaagggcttctcctcctgctgggtgggctggccggtaaacagatcatcatagttcggcatacattacctctccttttgctttttgattttcttttttgggggtgctttgtgctggaccggcttctgccgcccagcgttctctctggctttctcctccgcccgctgcttctgctccgccttgatctccttcaatgcctgacggacagagggacgggggcgctccagcggatcagggatacccggctcggcggcctctttgggctttgaggtaggctcggacagacgggatttctcggtccggcccacggtggggttttcggtcctgccctcctctctggcagaggacgcgccccgcgccgccttcaaaaattcatccaggtcccggtccggatcgttgcgctccggaacaaccgggccatgttccggggccggggcaagcatggcgtccagaaatccatccatctcccgctcagtcatcggctcctggggagtgtccaccccggctgccggttccgccgcaggtgtttccggggcgtccatccgccgctccacccggctctgttcgatctcctgcttgacctgggccatatctacggtggcaaggccgaaccgctcaatgatgcggttgatcttgccggcgtcctccgccctcgccatgatgtcggtcagtccatccgtggcgtcccggtccttcaatacacagtagaggacgccgtacttttttgcctcccggcaaaagagctgaaggtcgctgtccttgacggcaaacaccttcagctccttgccgctgcggagcatattggtcaggcgggccttgcccgccgtctttttctgctcacgcaggatggcatagatcaaaatggcaagctgtttggccccggagccggccagcctgaccgcaacctcacctgtttccagcgacatcctcacgacttgctccgccgcgtcgcctgaataactcatcgtttgatcgctcctttcgttccaattccttttgcttcaccagccgtcccaggttctcacggacctgcccggaacgctgggcgatgccgtcacataagaccacatcctttctcactgccctgatcctgtcggacagggaactgatattctgtttcacctcgtcaatacctgcgaagtcgccctgtctgatgagccggcgcaggtcctttcggagttcctgccgctgggcagtcagggcgttcgcctccatcaacgccgtttcccggtgggtagtcaattcctcaatcgttccaatgtggtgtttccccaaaaagcgggtttccgcgtccagacggtccagcttggcgatgtcctcccgcaataaaaaagacacccgcttgacggatgccggctgcttgacgatgatgtggagttcatagcagtaatggaagtacagcgcccgcaggccggtgactttcttctggggctttccccgcacccggtaatgctggggcaggtgatggacaagctccgggaacgggggctgcttgtgaatgttgcgtagaatacgcaccctgatctcctccagcgtgtagccctcgcccagcttgtggaagcggaaatagcccctcgcgtccggtggcttcaatgcgggatatttcaggggctttccgtccttcccgtgggtcttgacctgatagcccatttcgtccagcacccgcaggaaatcgcgctcagtagtggaagcgcggatagcccggtcaatgtcggcccggatagtgccccggtgggtgggttttccatcacgctcggcccgccattcggcatagtcctttgtctgtctgccagagttctcgatcacggagatggcgtattcccggcacagacggtccgatgcctcccgcatccgggcgtagtcggcgggggagttgtagaacttttttccatcaacccaggacacggagttgatgacaaagtggttgtgatagtggccggtattgcagtgggtcgccactacaacttcaaaacgcccgccccacagctcctccgccaacctgacgccgatttcatgggctgtctccgccgtgacctcatccgctttgaaggactgatacccgtggtagcacacccggccacccggcttgccccacagccgcttcgtttccatgaactgtgcggcagcggtgtcctcccggcagttcaagcaggacacataggaccggcgctccgttttcatctcgtcggcggcatactccaccacatcctcaacggcatggagggacgccagctccggcaagccggcctcagtggtcttttccgggttccgaacgtagtcgattaccttgtccacgcgcctatgaatgggccagatggaggtcaccgccatgtcagtcggaaggcacggtataggtgtctgcgatcagcttctccacggcccggttatcctccagtgccttgcggagctggggcacatccagcagtccgagggcgttggcccgcttcatgacctgattcaggttattccccacgcgccgcacctcctggatcagcacaggtacatcggcgggcggggcctccttcacctccgtgccgttcaggacgcggcggcagtaaccctcgcgggacaggccggacttgcgggccttcttggtaagggcatccagttccgttttggtaaaacggaccttcatttcaagtgttcttttcaaaacgatcatcctttctcaatgcagggtcataggggcggcaagcccctgtcaagcggaattgtggccccacaattcgttgcttgctaagacaatgcctccatcctccgcgcctgcggcgcgtgagagcgtgcgggcttggcctctttgttatcgctcatgctctttttcggttcgcatgagggccttcgcccgctccacttcatcggacatcatatagcaccgctcaatttgccagccgttcttgccgccgtactccgatgccatgtactgttccagacggacacagggatcggagccatccagggacgaagcatagatggaatatccgcccatattaggccgaaacgccttgttgtcgctggacaccgcataggtacggctttccacggaatactccttgtcaaagctggccggagagaacacaatgaagccggacaaatgctggcgggcacgttctgctgcgcgaaaataacttcgcatggttgcataggtcatattgacttcacaaagggccttttcactcatggagtgacaacctcctattatgatttttgcggcatcataggtgatgccatacccctcgacgggcgggaaaaagcggcatcataggtgatgccgctaaaaactgttcaggaagtcaaacacggcgtttaggtcctccgtgctggcttccgcctgcgccgctggccggtcatagccgttctttgcggttcgctccaattcttcagatacggtctgacggatcagctctttcaacacattggtttgctcttttgcgttgatcctggcgatgatctcctgattgatggatcgggcctccatgcggtgcagggcttcccacgccctgcggtcattctcccggtcaaggttaaatcggagcgaaaaccgtttggtattcattctctcgtccccctgtgcaaagcctgctcacacaggaactcatagcccttggcggtggcgcagatgtcctcgtagatcgttacgcggtcggcgtcataagccccgaagttgcggaccagacagcttccgccgcccagcacatggagccgcataagagcggggttgtactcatgctcccgcaggatgcggaaaatctcgcccacatactctgcggcggtttcccggatggtggtcaggtagtcctcccgaatatccgctgtgccgaaccgcagcacccggttgatgatcgactcgtccaccgtggcatggtgggtccgcatgacattctcccggacggccagcatacattgatgggtgccatacttctcagtaaacatccggtccacaacaggcttgcggtcgttgatgaacatgatgttcatggtgccgttgccaatgtcacagagcatattcacgccctggaagtccctgatctggccggcaaccgcagcgaagccctgggggaacacatccaccccggcgatctccacccggtaggcttttccccggaaggtaaaggccagttcccggttccgcatgaggtaggctttgaagtccgcccgctgccgactcacccaggtgaggggcaatcccactgcaagatataccgtggcgtctgtcaggccatatacattcagctcacgggcgatagcggccagggtgaggatatagtagtcatcgtccccggtcttgtccgccttaaactccttgtggcctgtcccaatcaggtagtagcgtccgtcatagaccagcagatcgtctttgaataccggctctgcgtcatggacggtcagccccgcgggaaaacagcagtttgcagtcttgatgttgccgtagccattgtctatcccgatgatcttcatgccctgatggtctttcaccggctccattcctccttcctctttgcctgccccaacctccgctggagcagcagatcgtttacatccttgccgctgggcggcggcctgtccagcacttcgtatctgtcccccaggccagccatgatacccgctgccgcgtcccggcccacctcgtcattgtccaggtggaggcagagcgtgtggacgccggggtggtcctgaaggtactggctgagagccatggggatgacaaactcttgtttctgcttgaacaccccgcccagggagagcatggcgtcctgccgccagtcccggcccttcattttcagcagggtggcgtagctcaacaggtcgatggccgattcaaacaggtggacgctgggtacagcggagtcctccgcgatggcgaaggaataccgcttgtcactgccggtggcctcgcccttgaagtcccctatgatgccccgcagggcggcgtagcggggttggccctgccggtcccggcccacgaatacagcattgtgatagggcagactttcatacaaacgcccggtctggatgcagtagtcgatcacatcataatcaatgccccgcccatgaagatagctgacaacatgggttgcacaccggctggattggggaaggaccagcttccggggttcctgctcctttggcctggcttgaggcgccggagacgggggagagaagttcggccccgtcagggcctccactgcctcggtaaaggaaaagccctggaccttgataagatagtccagggccgttttcccgccgattttgcgggagaaccagttccattttccgttgctgatcttcaagctgtcatgctcacgggtgcagtaggtgcttccgcctacatggacgagctggtgcgggtcataccgctggagataggtcagcaggtcccattccttagcctgagcgatctgctccggggtgacatagcccatcctaccgttcctcccgctggcccttttccttttcagctcgtatgacggtatctgcgcgggcctcgatcacatcccgtacatcgtccatgtggtgggtttccgcccgctcccacgcccggtaaacatccgccagcggggtccgggaccgcagcagagccgcggcctgggcgtccgtcagttccagtacctccaactccatcacaatatcctctcggaccgtgaatttgcaggcattgtccaggatcacattggggggctgctccagaagccatgccttatacttctgctgctcggctgccatccgttcataaagttggcgcatcatttctttgttggtcatgctgtatcactccttataaaatagtgatagccgggagatctccagatgaaaacctcccggctatgtaaaacggcaaggccgcagacacggccttgccaaaaaggtatgtgattgctttatcgggcgttccggtctttcccggctttgtgtttcgctggcagaggtccatctttcgcctgctctaatttttccagagcaaaatccagtatcttcaccttccgctccgccagcatggtcagataaaattgccgctgcaaatcactgaggaatggggtgtcataaatcaacttcccgattttacccatatcaatccgggggacgatcctccgcagggcgcggctgcacccctcttcccgcagtgaggaaataaaatcgaaataccgaattttctttccttccagcgtaatcgcggaggtcggtatctcataaattcgatagtcacggtcgccctgattggtaaggacagaccgcatgatctcgtcatccgcctggggatagaggcaactcccacaatcgtagaccggggccagttctatggcgtcgctgacggcatcgtagaggaagccccagttcccgttgtgccggtcccagttcccaatcagggcgtctacgatgaacatatcccaaaagcggtccagcagttgagcggcgtctatggccgtttgtgccgtaatcgtatggaggatgtcggacagttcggtgccatacccgttgcgctctgagtcgatgatctggtttttcagggaggcaaagtcctgaagcacgagcccaggccgggtaaagtcgccgcaggcaacaacgatcttctctgtgccattcaccgtgaatgtgcccagcagggtcttttgtacggggatgccggcaatctcgaatatctggcagccgaggtattcagaaaaacaactgttgctgtaactcatgtccgggtttttcttcgccatagagggaaattttagcatatattgctccccgtcatagaggacggagatcttcttgccgttcgcgccggcgtatgccttgttcctttttggcatacctgtaaagtcaataacgcccatgtggtcactccctttccatccgcagatacttctcccggagataccacgcctgttctgaactgatgacctgattgacctccgcgttgttgatgtctgtctgcaagttgcagtagtcgcagtcccagcgcaggtccttctcaccccgatccagccggtcccaggccgcctgcatctgggctatggattccatcaaaaaatcaggcaggccgcactccagataactcttatctgttggcagtccggtatcgctctcataggccggggataattccatgatgtcctccatggtgcagtccagcgccttggcaagttgctggacagtcttggcggcacaccgtccgatctcgctccttccggcgcagatgtcaacgatggtagtattggggacgccgctgatttgcgccagacggtatttacttatgccccgctgattcagatacccttgcaggtccataccctgtgccttcctttcaatattttcctccattatatcggcataccgattgtctgtcaatcacttatgctccctatgcccaggaaaatagaattacgatgattataaacgaataaacatcgtgtcaaagtcctcgaacatgaattgtattttgtcgatctgtttccgggtatggtagtggccgcagtaccattttttgtagtccaggcggtcctctatgccatccagccagtcctcggtactcttgtctacggagctttggtcaaggccggagagaaatacttcggtcggctcatatttgcgggggcaggtgtggctcaaaacaatgtcgatgttccagtgtaaggcggcaagccgcgcttcaaccacggctttgatctcctcgtccggctgctcatccggccaccaatgccacccgtgcgccagccggtagtgcttatccacactgtacgcgcccccgatcacgatacacttgtacccatcgaaattgtaaatctcgccgtcaacagcaaagaggatgttcggaaatgcttcttcatagagaattttcccgccgcagtattctccttccatataggatgggatgcgctggggcctggcttcatggttgccgtggatactgaagaatttgaccggaatggcgctggcatactcttttgcgcgggtgtcgcggtcattcaggtaataattgaaacccgcatcaccaaggatgattatggtatcggattttgttgtttccattgcgcggcaaaaggtgtccacgcggagaaagttcccatgtgtgtcacctgtgagataggttgccatagcattcaactccattctatcatgaattttgataccgtatacaggtgggcgtgggacacccatccgcggaaatgatacaacaaactatgtacgggggcaagtctgcggcttgctcccgtatcatgtttttgagggtcagacatttctcactctttcagcgttcgcggtcgggactgccacgggcgggggcggtgacttcatcccctacatctccatccacgatctcgctctcccgcttgtccatgttcagcaggatgttcaattcatccaggcgggcggactttcttttcagctcgtcctcctggggaaagggcttatccacctccagtttggcgttttcgagctgcatcctggtattttccaactgttcccggcaggtgctgatccgctcctccatgctttccagcagattgtccaggcggagaatgttgccaaaaacatctgtgccgaggttcgtggtgtagtacagcgcccctttcagcgtgaccttgaactccctggtcaggcttgcaaaggacaggtccatagaaaagccccggtactggcccagggggacaggttcggggctggtcatggctttgcaggcggcgaggatggcgctgcctgcggcttttttgtcggtgtagacggtcccctccacctccatgggggagaagccgtcctcattggggtgggtgttctccttcagccggtccatatcggaaagatagccctcaatagactgctcatacttggcaatctgctgaggcagcgtcttaatgatctgatcctccagagcgtaccgctggctgaggtggttggctttcaggagccggagacgctgcacatcaatgtccaggtccatcttctccttgatgtggggattgccggtgcagagcgccttgatttccgcgtatgacagggcggtttcatctatatcctcgcaggaccggaccggggatttgctggtcatgatctgcccgatgaacttctgcttgccctccaccagctgatagaggtagctgtcaaaggtgttctcggtaacataggtatagatgtccacctcgttgttctcgttgccctgccggatgatccggccctcccgttgctgaaggtcggaggggcgccagggacagtccagatggtgcagcgccacgagtttcttctggacattggtgcccgcgcccatcttctgggtggagccgatcagcacccggacctgcccggagcgcaccttgccgaacaactcctttttctgtgtctccgtgttggcgctgtggatataggctatttcttcggctggtatgcccctggcaatcagcttattccgcaggtcatcatagacattctgaaattccgccatctcgtagccgccctgctcgtttgggaccatttcaatgggccggttcttgccaggggtggagaggtcgcagaataccatctgcgcggaacgctggtccgctgtgcgctgccatatatcaaacacatccccagcacaggcgttgattttgctggtgtcgctgtccgggagcaaggggttgaggagccgctggtccagggccagcttgcgcccgtcgttggtgataagcagcatattgtcctcggtactgtccaccatcctgttgcggaccttctccgcccgctgccccagcgccgccaccatctccttctgctgttccgagggttttagcacgatgttgtggtagttggccttggggacggggaggttgagcatatccgccgtctggatgtccgccacttctttgaacatagacatgagttctgggaggttgtagaaccgggagaaccgggtcttggcccgatagccggtgccctccggggccagctcgatggcggtgacagtctcgccaaaggtagacgcccaggcgtcaaaattgagcaggccgtgttcttccagggtgtggtactgcaaatacttctgcatggtatacatctccaccatggtgttggagatgggggtgcctgtggcgaacacaacgccccggcccccggtcagctcgtccagatagcggcatttcatatagaggtcgctggacttctgggcctccgtctggctgatgccgcccacattccgcattttggaaaaggcggcgaggtttttgtagtagtgggcttcatcgacaaagaggcggtcaatgcccagttcttcaaatgtgaccacatcatccttacggctctggtcgttcaactttgctaacttggcgtcaatggacttttttgtgcgctccatctgcttgatggagaagcgttccccgtggttggctttcagttccgcgatgccgttcaggacctcactccgctgctgttccagaagataccgctggcgctccacactcaccgggattttctcaaactggctgtgtccgatgatgatggcgtcatagtcgccggtggcgatcctgccgcagaaccgcttgcggttcttggtttcaaagtccttcctggtcgccaccagaatattggcagaggggtagagctgcaaatactccgacgcccactgctccgtcaggtggttgggcaccacgaacaggcttttttggcacagccccagccgcttgctctcctgggcggcagctaccatttcaaatgttttccctgctcccaccacatgggccagcagggtgttccctccgtagaggatgtgagcgatggcgttcacctgatggggccgcagggtgatctctgggttgatgcccacaaagttcaggtggctcccgtcatactcacggggccgtatgctgttgaacttgtcgttgtagagccttgtcagacgctccctccgggctgggtctttccaaatccagtcctgaaacgcctgcttgataagctgctgcttgccctgggcgatagccgtttccttcttgttcaggacaggaacacggttgccgtgttcgtcctccacatagtcaaaaatacgcaaatcccggaggttcagggtttcctctatgatcttgtagccattgacacgggtggtgccgtaggtgttctccgccttgacattgcccctgtcggcaaatttactttcgatattccatgcgccggtgtgctgggagtaatggctgcgtatcatccgctgactgcggggggaagtcccgaacagttcatagataaattggtcaatgacctctgtgggcagccaggtggcccccagccggacggcgatctcgctggcggtcaggtccaccggctgcacccgttccaaagcctggacatgggcggtgtagtcctccgggtacagttcggcgcttcgttttgcccattccagcttctcccgcacattcccggagaggtattcgtccgcggtgaggtacttttcctcggagccaccgccatactcgtgcatggggttcaggaagatcacgccggtcaggtcggcgtagacctcctgctcggtcttgccggtcagctccgccatatagtccatgtccacctttgccttttcagccagtgacacggccagggcctcggacgcggtatctacatgggtgatcgtgaccctctgcttgatggtgcgcttggtaaacatatccgccttgcggacaaagttgcgctcatcgtccagcacctccagcgaagtcaggaggaagtaggcgctgtccatgctgaacacggagctgttggcgcgggagttgatccgcccgtacttgtccacaaaggcgtcgtaaagagcgttcaacttccgctgctgggcctgaatgtcctggtcgggccagtcctcggtctggtactcaatgagcgtccgcacacagtcccgtatgccgatcagccccttgatgcggttggccgctgtcacggacacctctaccgggttcatgcggctgttttcccggtagtacaccttgccgtccacgatggtatagctgaaattccgtacctccgggtccgcggggatggacttgtcctcgccctcgatttccgggtcgtccatgacatactcggtgatggagccttggatattctgaatggcggcggcaagctgttctcccaggtcccgcccctcgatgggcaggcaggcggtttccggcccataggggccgctgatctcccgcatttcgcccatgaccatctccgggtggtcaataaaatactggttcattttcagcccgttggcgtcggtgttcaggtgtacccaatccggttcctcgctggagagggcgtcccgcttctgcaaaaagaggatgtcgctggtcacatccgttcccgcggcgtccttgaaagtgttgttgggcaggcggatggccccagcaggtcggcgcgctgggcaaggtacttccgcacagtgggggtgtccttgtccatcgtgcccttgctggtgacaaaggcgatgacaccgcccggcctgaccttatccagcgtccgggcaaagaagtagtcgtgaatgaggaaattgtatcggtcataccgcttgtcgatcaccttgaaggagccgaagggcacattcccgatagcggcgtcaaaaaagctgtccgggaggtctgttttttcaaacccctggacagcgatagacgattgttgatagagttgctgggcgatgcggcctgagatgccgtccaactccacgccgtagattttagagtccgccagggcctccgggcgcataccgatgaagttgccgatgccgcaggacggctccagcagatttccggtctggaagcccatgttcgtgagggcctgatagatggagcggatgaccacgggcggagtatagaaggccgtcagggtggactccctggctgcggcatattcctcctcggtgagcagggctttcagctcggcgtacttgctgtggcgctcgtcaaagcagtctgccaaaccgccccagcccacataccgcgccaatacctcctgttcctccggggtggcaagccggtcctcggcctccagccttttcagcaggcggatcgcccggacattgttgttgaaccgctccccaggggttcccacgcccagggcgtcatcggtgatgtggtactcatgccggtctgcgttgggaacttcaggatggaggacaaagggggaaaccctggccctgcgctggggggccagtggcggctccgtaccgccttggtcgtgcccatctgctgaactttccacgccctttcccggtcccgctgtcttttcagccggtcccatcagacgccgaatgacggaaatatgctccacgcgctcgatggggaaaccaactgcgccctcaaaggtgagatcccgcagggaggcccggccatcctcgtcgatcttttctacacgaaaccgccggccctccagcgtgatctccttaccgagcaggtcacggtccgaagcagccgtttccgtatcctcccgcgggggcagaggttgttcctcttttgcggtgggaggttccggtgtggggaagtccccgatcacgcggagccacttcttctccagcaggtcgtagacagccgcgccctcgtaggcaaagccgtctggttccatcgtgccttccagatagccccgtgccgcctgttccgcttcctccggcgtcgcgtattccagcttctcgtccatgccgttttccaggtggtgatagaccaccacctgataccggcgctccgcttcgtcccggtccgccggggcatgggcgggcggcttctcccgtgcctggaccttttgggccagagggcggtccgcataaagttgtttctccgcctcctccagtttggcaaagctcccggtcgtgggcgtcaccctgccggaaatgaagccgtactgattgcagaaggtcccgttcggttcccggaagatcacaagatgctcatcgccggaccaatattccgcggcctgccggtacgcgaggtcttgggcggcgatggggtctttttttgcttggggccgatgggtataaagtgctgcttcggcctgctcaaaggtatcaaagccactcgccgttgcatacaccgtgttatcctgatcgtcatagcagtattggacataatactggccgttggggtactgccggatcaggatggtttcgccctccccataataccgggcgcagagctccacctggttcaactgacgggcgtattcctccgcctgccaccggctggtaaattcctcgctgacgccctcatcgtccacatagatacggtcgttctggccatcccacacgccataggcgatttgggagccgcggtccagctccacagcatagaagcggacatccggctccgcgccggccttctcctcttgactgggcgctgtgtccgcggggtgttcccgtccctggcgctgtttgttgtactcctcctccgcaaaggccaccatctcgtcaaaatccaggttggcgagaagttcattcaggtcatggaagccggcgcattggatggaagcagcctctgagccgtccaccagataggacaggcggaacgataccaagtccacactgatctctacggtgtgggcgctgtcgctggtggagctgaacgccagggggacatgagagaggtcggagaagtcggcctcctgctcaaagacctccatacagtaagcgttaatgagccattttgcccgccccaactgcgcctgcgccatgtcaatgacctggaagccctggggcggcgggtccagttcggcaaggaagtcctggggaatggtctggccctggccgtcccggtagaggacgatccgcatgggcgcgccagcatggttttcttccttgattgccgccacaaattcctccgcgccggtgtactccacgctttcgcccacgctgccgttcgtgcccaggaagtcgatccgtcccacgggcagcggggcgtccggcgattccccggcatccggttcttcggcgtcagccacgggtgccgcgttctccgccacctgaagcagtctgtcgttcagcgggttctccgccagcagacggtcgaattcctcacggggcagttccttattgaaaataggaaaggtcgggtcatagagccggacggtctgctcattataggccagcagctcatactcctgcgcccccaggtacaccgtgtcgcccagggtcaagcggtattccttttttggagggggcggcggattcagttcctcctcggtgggttccagcggtgtggcaaggggaccgctcagatcagccagcacagcctcacagcgttccgtcaggtgggtcttgtcccggatgatcgtctgcatggcgtttcgcagggtgggtaggacaaagagattatctcctgacagaacatagcacttcttttcccctattctaaaggagttcgcacacgttctggcaagtaggagttccttgtatgggtccgtttcaccggtccgtgttttgaaatccacataatcatcaatgatggagcaaatctccgctgcgatgtcccaacgggccttccgctgctctacctgtgcccggtatttcggataatgctctttttcagcccggttcaggtagcgtccagcggcaatcagttccccaatacgcttttccaccttggcccaggtcagcaggaatttcccgtcagggtcgccgtagtcgcgggagatggtgatgcccgtgctgtcgtggtctaccctaaagccgctgctggggatagcgttggaataggagcctacgccgtattccgctttcaggaatttggcattttcctgtctgctttcctgcttctgatactggtcatagatgcggagtttggacggtgagtaccttccgcacagaacatagtcaatggcctcctggggcaaaataaaagccgaagccttttctgcttctgcctgttctatgagagagacttgtttcgcttcgctgggcagggggcgctcatccgggtcgagccactggtgcagcaggatcatcccgtagatggtgtcggcaacatggggccaccgaaggaattcctctttctcgcgggagaagtacgccccgcgccagaggttcagcacatcgtcccatgcccgatacccggcccgctggccattgctcaaaattttctccacataggtgttgtcaaagaaacccttaatgaaatcgccgcgctcttttctgccctcatgggcttcaaagaacgcggcgatctcggtcctatggtcttttagggcgtcgctgatgcggagtaattcctgtttctcgctgtcctcatgatagtaagggatgtccgtgcgggcgtcaaaatcatggtggctgttttgaagtccggcagtagcggatgtcccgtcaacaggggcctgtggaagttcttccccagcaataagcgggccgcttatgtgtccgcgtagaccagctctgtcagcgccacttcctccgctgctgcccggatgttgttcatcaggcccacccacttcatctgatcgctggccttcagctcctccgtcacgccctgctcccgcgccatccgcgccatcaactgctccaccatctccgtggcctgccggtcgatcttctccagatgggcgttcagcctgccgctgaggagcatccccgtgtagtaggcgttcctgtgggtctgaaggtaactgcgccgcagcatcccatattttccgaccttcggggcctccggcgcttccagattgggcaggcggtagtcgccctccgtccggtatgtcagttccatgttcaatgctcctttcctgttttgtcctgctatcatgatacggcctgtttggagtttgcgcaaatgtgcgattttccctttgctctgcccggtacaggctcaaaaccgtgctggcgatctcccgcaggggcatttccgcaatatcgctcaccgcgccgcccaggatggagagggtttccggggtgtcaaagtcatagacatgggcgaaatcctcgccgctgaaatagtccatggggtcgatgccgcaccgggtcagcatgataaaggccacgctgttctccaccagacccttaaaccatgtttcagtgctgagatcgtccagttcttccagcaggctgcccgccttgacaccccgcagttccgtgtagtagtcgccaaggttatcttccacgatgacctttgccgtttccagcaggcaggcggcaaggccggagcggtccgggaactcgccatagctgttctccagtgcctcgattaccgcgttctcataccgcggctccatcttccagatggggatcatgcgcccctggcggctgttggtatcggacatatcaaagacataccgcagcttgtagccctggtccgtgtccaccagcagggcgatccccctggtgccccggttaacatagcggccatgcttgttccagaagtcgatctgggcgcaggcggtggcgtccggcttctgtgcgtaaatcaaaagctggtcgcggaaattgtacttgaagttgtgggcggcggtggtcaggaacgccatatagttcccgctgttggcggaaatttcgcgggtcttttgcgccgcaagttctacaatggagtccagttttttcgccacactctatccctccgtttcttcataagattgtagcaggccctttgctgctgcggcgattttagagatgcgcccggtgagctgggcaacggtggcccgaacctctgatcgccgcgccgcgtagaagtagcctgcatcggcgctgcaaatggggtggccgtcacagcgcaggcggttgaccgcccgccgcagctccgtcccgccgacatgaaacgcggcctccagctccttgctggaagctgcgttctcctgtcccttgtggtgtttcttcaggtacgcgcacagggactcgtcaatgggtacgcccttcattggggatcactcctgcttcccaccttcaactttttgtgatattcctcgctcacatcatagttgagggctgcggataaaaggagctgccagatcatttcttccgcttcattttcatacatacacagactggcgtattgttcgccgtctttactcatatagagccgggtaaagcgcatacgtttctccatcaagtccttcgcaccgcttcggacgctctccacgggggcgttagcggcgttgtatgccaggacagtcatcaacaggtcaaacatagaggggtgtagttctaatttggtgttgggtatttgtgccatcatcgtcctacctttccacggaaacggcctgccggggcttgggaaaatcccagccgtacaccttgccgatctcgtctcccagcctgcgggtaatccgggttatatcggatcggacagcctttccgtaatacagtttttctttcagcaagtcaatttgtgagtcccgtgctccgggcttataggtgcggtaaagaagatggttcgtaccgtcgtggtgtatggcgtcgcagcgcaggtcgcccagcttatccacataccatgtggcgtattcaatatcccggccactgtaaaggcagtcccggatattgccgctggagatttcctgatagcctgtacgccgcccattccaaagtcccaggtcagcgatcacaaggatgggctggtcaagctggatgttcagattgacgcgctcatcgtccagatagcggttattgatctcgtacatcagggccatgcgctcgtcctcggtcagctccggatgatcttcctccagatcgtccctccagtcctcatagtccagatcgtagttgctccatattaagtgcctttgctctgtcatcgtgaaccgcccctttcgtggcggcggggcttgacaggccgtcctcgctcgttgtagcggttcgggtcagcggcaggggaagtccagccctgggtcaccccggccagcatcgccgccgcctgcgccctggtcacgcccatatcgccgttgagcacatccgccgtctgctggggcgttttccctttgaaatgggccataggggacacctgatacccaggcttataccgctctatgacgatcagctcgccggatgatggcaaaatggcaaagcacttctccggcaggggtggtgtcagtggcaggacggtgttgtggcagcgttccatctgctcggcaaactggcagatgtgaaacaggctgtcccagccgttgcctacctccacatggcagtcatcaatatagcggcaggtccggtcgatgggcgcacagccctcccggagaatacggatttgcccgccgtccgggatgcggaacagttccttgtagtgcgggtcgatgaaccggatgcccttttcagcctgttccatgtgccggtccagccagtcgcggcggtagcagtagagaaacagattttcctcccccttgtaggggtgcagccggatcagataggcatactgtgctgtgtccgcccggaagccgaacgcaaagccgctatcgtagccgctctcctggtgtccccggcagaaatcccgcatggcgtcacggcttttcagaaacccgccgtactgctcgtcccccaccagggcctccaggacctcctcaaactcctgctgaaagtcctcggtgtccagattttcccggtggctggtccacttgggaaagaagcccttgccatcctcacccatatccgctcgaaggtgcccgatactcccagtctggccctcaatctgtgtgctttgtctggcaatataaagccgctccgctggagcagcggcgtgaaaagttaattccatacgatcacgctccttgtcaacaagaaggcggccattagcttcccactgatagccgctttctctctatacgatattgatagaccttctaccgggcgtcgccccggtcgtggcgcttgggcttgatgggctggccctgctcatcatattttttcgggtcggcggctggcacctgccagccgaacagggagccggccagcatcgccgccgtctgtgctttggtcacgccgccgcgctcgttacactcacttacgatctccagagcctccgcccggtcatggccgtacttgtctgtacggtaatagccgctctcgccctttttgacaataatgatttcatcactgctgggcagcacagcataacacttgtccggcagggtggaacgcatgggaatcaccatgccgcctgtttgctccagccgctccgcaaactcccggatagaataaacggtgctgccccactcgtgggacagttccatgtggccggcgtcgatatagcgggcggtgcggtcacgggtgccatctccgcctgtgataatgcggatctgctccccatccgacaccctgaatttctctttgccgtccgtggtgacaaagcggatgcctttttcggcttccttcatgtgccgctccagcaggtcccggcggtaagcatagatatatgcgttatccagcagctcggatggcgtacaacggagtagataagcatggtagccggcatcaacgcggaacagatattcggggctttgtatgatgcggctttcctggttgttcaggcagtaggcaatcatcgcggggatattcttcagcacagggccatatcgctggtctgatcggagcatttcaatcatggcatcgagttccaccgagaactccggtgttttccatgcggggtcccaaatgtcccaatggctgtaaaacgccgtgccgctatcgtccaattcagcaactaagatacccggacttccgcaccgctccatgatcggaatacactgccgcttggcgtatagtcgttccgttggtgtcgcaggccgcaaagtcagctccactatcgctcacgctcctttaccttcggctgctgtgcaggctgtgtcagtccggcctcatgcgcccgccagtagtcgggatggcatactcggatggtatcatcaatacatttgctgtattctccggggccaaagtattcattgaccggcgcggtgtaaagcccccggtccatcaactcccgaaggacgatctgcgcgtcgctgtcctcctcaaagcacagatagccgccttcccagaacccgtaccgctgggcggtgggtgataaattcccggccacaaattcccgcgccaccatgatcccgccgtggctggctgtggaaacatcgaagaaaccagggcagagggtcttgcgggtctggataagcccccagggagaataggctggctcatagctcattcccgctcacgctccttccccgatttctccggctgttcgccggagcgttcctgctttgtcatctggtactccagttccgccccggcccgttccagaaggtcctttttagcggccaggagatcggagtgataatggccccagtagtagtaatcacttccctgacaggcccatgtcacaaacatggaccgttccgctatgctcacacccagcacgaactcggtggtcccgatgtggatggagtcggtgataagatagccggcgttcatacggctgcccatatcagcggccctccctgtcacgagagtttcgttccttttcagcctgtcgcagctccaggtaatgctttgcccatttgggcaggtcctccggggcgatgacgccgagaatgtcgctgcgctcaaaccgcgccctctgcccggaatacagctctgtgcagtaacaggcagtgccgcggctgttggggtatgcgccggagccgctggtacacaactggagctggcaggtggcgtggcggtattcccggcgcagcacctccgggcggatcaccacgactttgccccggatgtcctcctggtaactgacctgttcacagtcctcggcggtgatggctgaattggggatgccctgaattttcgggccgttcaaggtgatatgggtcttttccgcctgttccgccacacgctccccaaacagctttaccagttccgggtagtcatcgctgaccatgacctcggtatagtttgcgaatatctcatgctgctggcagaacgcgcatacataccgctcatcctccggcgctgacgggttttcccccagcacgatctcccggtcgccaatgtgaagcgcatggatgatctcatagtccccggccatacgcttttcctgatctatgtccatttgaagtcctcctcgtataataagtttcaaagttaatagtttcaggtatcagcaggctttgaggtgcccgtgatacaatagctgtaggacagcagggtcaagttctgagtcctccggttgagccgtaaggctacttcactgaaagtctgttcccctgaaccggaagttagctgcaaactcattggctgtttgcctgggacaagaccgccctttcagcagtgagggctatcgcattggtctgcccaggaatgattctgataagcgagggtgccagatgctccggttatcatgggtatctcaaagcctgctggcctgaaatctccatgcggggaggtgaaaattgtgaatccactattcgttggcattgatgtgagcagcaagaacaatgtggcctacctgatgaaaccggacggcagcaaacactccagcttctccgtgcagaataaccttggcggtgctaaactgttatcagagagaatcgtatcggcacttggctccatgcagcttgagcgtgtggtgattggcctggaggccacctccatctacggggacagcctagtctatgctcttcgtgaggatggccgcttggggcggtttcagaggaaaatccatgttctaaatccaaagcaggtgcggaaattcaaggaagcctattctgacctgccaaagaacgactgggtggacgcctttgtgattgccgaccatctccgtttcggcagaatcaacagggaggtctacatggacgattaccgctacaaagccctgcaaacccttaccagagccagatttgatgtcatccaaaacttgacccgggagaagcagcggttcgccaactacttattcctcaaatgctccggcatggcccaggacaaagacattcagaacaccagcgccaccaccatcgcactcatggaacactttgaaaccgtggatgacttggcgaatgccgacctggaggaactgactgcctttattactgaaacaggccgtggcaaatttgctgacccggatgctaccgccaaggcagttcgggctgcagccaaaggctcctatcggctgcccaaaacagtaaacgacactgtaaaccaagcaatggctgtttctattgcctccatgcgcgccttgaaagggcaggtcaaagtattagataaggccattgaacagcagtttgaaatcattccgaacactttgacctccatccccggtattggcaaggtctactccgccggtatcattgctgagattggtgatatccaccgttttgattcccaagcctcggttgccaaatacgccggccttgtctggaacaggagccagtctggcgacttcgaggccgaacactccagaatgattaaatccggcaaccgctatctccgctactacctgctggaagccgccaactccgtgagaagatgcgactccgagttccggcgttactatgacctcaaattcaaagaggtcaacaagtaccagcataaacgcgcactcgctttaactgccagaaaactggtccggttggtctttcggctgctaaaggacaaccgcctgtatatcccgccggagggctgagagcgcagcttgccactctgactcataggccctgtttcaaaatttctcagggacagggctttggttggtgttgcctttttgctgtctacacagtgctttttactctgtttcgcttaaaattttcttgcatcacctacttgacttcataccattggactcgtatgaacagcgtcatttcgttagcacattgtgagtaaaagaaagtggctgaatgaggataagatatctggcaaaatcaacatagagattttataactccgttcacaaacaggaaaaattcctatcataacttgaaagtcagtccgagaatgaaatgctgccagcatactttttgagtacccttagaatatcttatccgtaatatcctctatatggccctccagttgaactggggggttcgcttttcagtaactcttgatagtacgtcggccttgcaatagaggtaaatccgctcttgccggtaatgactacattgttgtagccgctggcgcagtggatgatgagcacattgccgtttccgtcaaatccacagacaatgccgacatggctgtctcccggatagaacacaaggtctcccggctgggcatcgctccaagcgatggcagtgcagtattcgtgctgcatggttgctccaccaccatgaccgataacataactgccgccagactggttgtaaaacacccaatcgacaaagccggaacagtctaacccgaatgaacgcaccgttccggtcgtagaactgcctgctgctgtgacctccataggcgtcccccagcgggagtcccagccgatgacgagggactttatagcgataggtaatccaccgcttttatcccggtgttaccgggacagtcagggtggattttcccccgcttcacaccgtgcttgcgactttcaccgcacacggcgcaccatcagtgcagattatttgttgcgtgtatgtgaagtaaccagtttattcctaaaacctttgattttcttttgcgcttcgctgtcgaactcaccgatatcctgattagggtcgttcacagcttcaaggcattttctgtgcatagagaccagattgttgacacggttcacttgattcagcgggaaataggggttgactctgtgagcgcaaggcgcagttgatattaaccaaccaccgcagacccggcatttaagcctgtcacggttaagcgcataggccctgttcataatgaactcgaaattgttgagttgcccccatttgctgtaacagacagcgcgggatgtactctctgagtacatctcatccagccgcgtattcatgcgtttcttttttgtgcgtttgaaataacgctgtctgccatcttccgaatatggcgtttctgcctgtgtcttcacgggcgtcatttcccactggcaaaaggagagggcggtaaagccaacatagatatcgcgatattttatcgaggggattttctgctggtgcttttgatgaacatgggataggttttgcgtttgatttgctggtatccatctgccaccgtattgctttatgcgcgccttggaaattatttgcaatcggtgggagtgtcgccgcaaggcgacgctgacccatgtacagcactggtagtattggataatccctcgaacttggctgttgatgcgattgatttccccgatgaattgttccttgctaaaatttctgggaattttcttgatatcctctgcgatactgtcaactttccgctgtaaccgttctttgtctggtattgtctttgtaatatagcctgttctgctgtttcccggtatcattttgagttcatagccgagaaagtggatgtgttttctccgcacatctgttatcagcgttttttctgtggataatgtcagcttgagtttgtcttgcagaaatgtttgcaatctggatttccattgttcggcatgggcgcgggtgtctgtgatgatgacaaaatcgtctgcgtaccgtatgagccatcccggattcagagaggtttgataaagtgaccttcgcttggttcccgcagtccggtaagttcgtcgagttttcttatgttcccactgctttgtgacccactcatccattatgtccagataggcattggccagcagcggactgataattccgccctgtggggttccgtactcgtttacggtgcattcatccatgatcccggctctcagcatagccttgatgatttgcaacacacgcctatctctgataccgatgtggtacaggcggtttagaagaattccgtggtcaatgttatcaaagcatttgcttatgtctccctcaacaatccagtatttagcagatgtgtgcgctacctgattgatgcgcgccagcgccatcgcggtatcacgcatgggccgaaacccgtaagaatgctcaaagaattgtgcttccaaaatcggttccagcacaattttcatacactcctgtacgatgcggtctcgaatagtaggtatgcccagcggacgtttctcggcttttcctggtttgtcgatatatttccggcgtatcttctgaacttcaaagtgcttaaatgcgttttgaatatcctgaattacccactgatagggtctctccagatagtcctttcgcatggttttgaaatctacaccgggagtctcactgccgtgattgcttttgatgttgtgaattgctgtgataacggttgcttctgctgacatgatttccagaagtcccttgaacgctggcctcccgcctgcgtcgtagacctctttgctgtgctgatacagcttgtcttggagttcgcgtaattgtgtttcggtttttggactgtcgaattgttgtgccatacgcaccgcctccctccggacttggtgtttctggttttagtcaggtatgcctacggcttcctcgactttctgttcacatacaatctgcattgactatgccccttcgctccacccccattacaggggcttcatcactactacgggctcctgccccgtggataagcaggtcatttcctacctgcgcgggcgagagtgtcatcccttttacatttccatgtgcccgtccacggttcctttgttccctatgctttagctttacatgttggttttagtccatccctctggcccgactgccatctttggctggtgtgaacttctgccaaagacattcgacctcaatggttttctgctgttctctgcgggtggaagcgtcgaacagcggcagcaccccattccggggctgatggctgtattatcatcctcttctttacgagccttactctcaggacttttgtcggttgcaacaagacatactggacatgaccgatttatagcctcctgcgggtgcatccatctcaaaccgcactaccgctctttaccgggcttcgcacacatcacatgacactgtgatatgcgtgccggagtctcagagtttttgttacccgtcacaccgggtcaggcaggtactccccctgccaaatcaagcatagagttcagatttcttatgaaatctgccttgttttattgcgtatttctacgcagattgtcaaggaacaaagcgcacccgccccagaaataatggactttacccaagagttgatacgccgtcagcacaacttgcctacgttccgcactaaggtcggcgggaagattctccataattttcgccacattctccgggctgagttcgatattctgataacttcccgtcaaagccatgaacagttcctgatatttcggatgcatgagttcctctaacaatctgcgctgttccgtgttgaattggtactcatccgccatttgcaggtgcgtttttattgtgacggtgatatgcaaaatgaccgtatccgcttcatctttgccgcctggtactatttccgtccaataagtaatggtgttcatgtcccagaagatttcacgaaggatctccattttttcttcggtcagcgtagcgacctcatccggcgaagcgttgtccgtggtggtccgcacagcataaacggccagcacatcccgccagttggagatcatggcggcgctgccggcgttgtccatatccagttcgtcatgcgggttctctgtcttgatctgttcgatccgggcggcgaactcgccgttcaatacgctgacagcttccggcatggtgtagccggtaccgctgtcctctccggagaaaaagatcccaaaaggcgacacaatcagaagtccaatcaggcaaatcaccagcaccatggctatggctgtactcccaccagccgctattgccgcaagcaagctctgggcagcggcaatgatggagcgcagcgcgcggcccgccgcctgcgcggttttctgcgttgcggtttctgccgcttttgtcatctgttgccgtttggccatctgcatggccgcttctctggcagcgtgtgttctggccgcagtcgcatggacggtggatgagtgcatggcctgttcagaggacagcacagcagatttgctgccctcacgcgcttttggcgcgatccccgcagcgtgatttggtgttttcagttcggggagttggtgcttctttggctgctggatgccgccgcgctctttgattctgcccctgctggttggctcgaaaccttccgtacgcagcgaatcaccacgcagatcatcctggtgccggaaccgccgctctgcccgcctgcgctgcgcctgctggcgggacgctttgcggccctgctcttgaatgaatgtctgctggccctgccgcttcgactcaggcgctgacgttacagcggtctcgccctgtgcgctgatataggcattcttcgtcttgactgcctgcttcatagccgcctgccgtgcctgctcccgcactggcggtgagggcgctcttaccctcgccgcgtcagtctctctggtgcggatgacaggcggcacgttgctgttggagctgggggcagaggcgtcaccctggggtgacgcgctctgctccgtgtttttcttcttgcgctgcttcagcagttccttttcggcgcggtgcaggccactggcggcggtgtcctcaatggcgtcgccgccatattcatcccgccgcccctgctgggcggtatcccggagctgagtccgcagacgctccgagccgtcatccagccccttgcgtaaaagctcctttggagcggatacagctttctctttgacacgctcactcagcgccggtttttctttaattttctccatgggctatcacgcagccaggtccgagggctttgtggtcatcaagcggtagagcttgttcttgggaaaatgatccacgaaaggcacgatggcacttccgcacttgatgaggccccggccggagtctacattggtgatgtaggagagctggttgtctgagatattcagcagacgcgccaattcctcccgatccgttgccgcctgattcagcatgatgagaaattcgctgttggccagcatggtgcgggccgtgtgagactggagcaggtcttcgatattctggctgatccccgttccgcacgcctgatactttctcatacgcttccagagtgtgaacaggaaattggcgctgtactcatgctggaatagcagatagatctcgtcgatatagatccaggtattccgcttcagcccgcggttgcggatgatgcggttgaagatgctgtccaacaccaccagcatacctaccggcagaagctgcttgccaaggtctcggatatcatagcagaggatacgggcattggtatccacgttggtgggttttgcaaaggtgttcaagctgccctccgtaaacaattcgattgccagcgccacatccgtggcttctttttccggctggcggagcagctccgcatgaaagtcctgcagggtcggggcctgcccctgatacccgccgcggatgtattcccgatagacctgggcggtacagcggtcaatgatggacttttccttggcagacagcttcccggcgccgatgagctgctcacaaagagacagcagaaactcagatttcagcaccacgggattctcgccgtcaccgtagccctgctccatatccatggcgttgatatggttgggtgatgtggcggagatgttgatgacctgaccgcccagcccttctaccagcgggcggtactcggattcagggtcaatgatgataatatcatcgtcggtagacaatgccagcgacaccatctccttcttggcactgaaggatttgccggaaccggaaacacccagaatgaaggcgttgccattgagaagctgcctgcggtccgctacgatgagatttttgctgatggcgttctgtccgtagtacacgccgccccggtcccagatctcctgcgccttgaatggcatcagcacagccagtgcctcggtggtgagcgtgcggagggcgtcgatgcggcgcagacccagcggcagcgccgtcacaaggccgtctgcctgctgccagttcagggttgtgagttggcagaggtgcttccgggcaatggactgcagcgtttccgtgtcactgtccagttcctccttgctgtccgccagatgcaccagcgtcaccacggcaaacatcatccgctggtcgcgagtggtgagatcgtccagcatctcacgggtctccttgcgctgttgttccaggtcatagggcacaactgcggaaaaattgttgttgctgttctgtctgcgctgccagttggtcacattggtctccacgcccagcaggcggttctgcatctcccgcaccgcctcgtcggtagggacagggatgatgtcgatagacagcataagacttcggttcaggctggtaagctcattgatcatggagtctttgatgtagctggcatactccttcagaaacagtacccggccatacttattgcccatgacaaagtggtctttcttaaactccatgctgtccggacagacggcgtccttgaaggaacggccacgcttcatgcagtctgttagatccaattggaactgcgtttcttcacccacgcggtagaaatcatgaaggatgcggaggcgctccacggcatccagttcctcacagcgggagtccatgtgattgagtcgggaagtcacatcattgactgtgcggtcaaaaaaagtacgggcttcctcgatatttttcttatgcgccgacagggtgatataacgctcctgtaccacgctgttggaggaatcggtaaccttatccaacagcatggcgttatactccgcccgtccgccgtccagaaaatctccgtgagcaggaatgaggatttcctgttcaaagttgcggcggttcaggcgcttattgttgatggtgatttttgtagtagagccggtatccagcgcgttcagcagttcggaatagctgagaaacatagctgtcttatcctctttggatgcaatggcgtaattgatatcgctgaatcgcagtgtcttggaatacttgctgccaaactgaaagaccccatccggccagagtcgccggatggggatggtgtcctgtacagatctcggtaccttgaattgttctttgtcctgttttaacgttgtctgcagggttttaatcaagattcaatgcctccttcacagatgagtatgccatcagttttgcgtacatattttccgatttgaacacaagccgttttggggtgagaaattccgagcgaaaaaacgccaataaaaattgttccagattcatgccgttgtactggaaaaaaccgcccaaggcaaatgggaacgcggccagaatgcagacccagccgatctcgccattccccagcacggggcgcagtccaaaataaacgcctaccgccacggctaccgccaacagggcaaataaaaactgccgcagtgacagtccaaaaaacaaactttcctgatagttgcgcacttccttgttgatgcgtacctccaatatatcaactccttttgagaattggcatacagcctcttgtatgatcggcacggctatggtaacatagcgccgtatccaaaactgagaggaggctctttgcatgccggtcattcttttgagcatagcaatgctcatcatctctatcattttcaagttggccgccgtatttcgcttgacgattccgctgctgtatgtggtcgctatgaatacattttggcgtagttggtatcaggcacaccaaagcctgggtgatattattttctttgtcctccttggtctggtagtcctgtcttggatcatttctctggttcggaagatacaaagcatcttccagaagcgccaggaagaaaaagacctggagagtattgttcgctatcgtatccgtgagcagcgaagaaacgatgtgcagccggatgagcacggcggctatgccatggacctgagcgacattgaattgtctgacgatgaggattaacccaggcccatcagttcccggatgatccggtcgctcatcttgatggcccccaccagcaccagcatattgaaaatcagttcacctacatagttccacacaatggtggctgccgccagcgtatcgtccgcaatggcaggcggtgaagacgcaaacgccgaaaaaattacacaagccaatatgatgacacagccctccagacagatggcggcatagcttttcaaaaaggctacgcctatactgctggagggctgtcccgcaaaactggccagcggcacaggggcgatggccgttgcgatatagagcttaaaaaaacggctatacaccgtcaggatcatcacaagggacagaacccagataaaaagggagcccaacagcgtcaccgcccataaggggatagaatcgaaaaagccaacatcctcgatgatgctcgccatctcgtccggcagcgctgttgccgacatggccgtcaggccagccgagtcgatgatcgttgtcgccatgccctgggctacccgaaaggcccctgtcatcagttccatgccccaggtcaccgccgcctgcgccagcacaaagcggatgaagcacttgaacgccagttccggtttcttcatctccgcaaagctgccgcaggtttttacaatgcccataacaaaaaacagcaccagcagcgcatatcccaccgctttcaatccgccgttgatgccgacgatgacattccagataccgccgcctttgaaattctccggcgatgtggtgatgagctgccagatctcctccagcctgccgttccacatctccagcgcggagttcaggttgtcaatgatccagtttccacttcccattcaaaatcacctccaactaaagattcaagattgaaaaaatatgttacaaatgctatactgcatttggccccaagaggcacaatggagagagccatcggatagcagggcgaccatatatggggcaattgtcactgcctatcgcggaggtgttgccgatggtttcggattttctaacagtcatgtcctttgtagttctcgtaacagcaaagtcgttatttaattcttgctctcctgattgtctctcaaatgattaagaaaatgctgtggatctgtgatggcccacagcatttttcttatacttagccggtgataagggtaaggatttccttggtaaaggtgatcacaatgccgcctgctacggtgagcataccgttggcgcgctgggagggatcatggctcttgagagacaggcccacctgcaggatgccgaaccccagtaggataaggccgatggcgcggatgagagagaaaataaactcactcagattgttgaccaccgtcagcgggtcgtccgcagccagcgcgggaactgcggtaaccgtcatcaccatggctgtacaggcaaggacggcgtagacgcgctttgcctttctttcaaagttcttggttttcagatcatgtttcattatgcagcagtctccttttcatcgttttgatcaaatcggaacagcggttctcccggcagggccggtgccgctgttccatggtggatatagggcggtgcgccgccgtccatggtgtagcggatggcagggtgattcatgagctcgtatttcagatccagcaccggtctggccccgcggatgaacaggatacagtaccggttgtccaacatccgcacctcatccggggtcagcagttctctgccgctcatctggaagttggtggagtaggaaccggagcgccccttcgtctgcccatgggtcttggtgtcgatggtggacttgcccagggcctccgaaatgtacttgtgggtactgctctcgttaccgccgaggtaaagaagggtatccgagttgccggggatggtttcccacgaatccttatacagttccttgatctgcgccatgttctggatgatggtgctgcaagaaatatttcgggagcgcatggttgccaattcccgcggcagaccgggcagattgacagacggagcctcgtccaaaataaagtggacatgacacggcagcgcgccatggtggatctggtcagcacagtagtacagcgcttgaaatatctgggaatacagcaggctgacgaggaaattgaaggtcgtatcattatccgggatcacggcatagagggcacattttttctctcccagggtatacaagtccatgtcatcatggtcggtgatggccttgatctgcggcagattgaatggggccagccgcacagcggcgcttaccaaaatacttttcgctgtcttgccagagacaaattgtcaaggactttttaatcaaattcacagaaaactcacaaaaggtgccagaagcactgtatggctcctgacacctcatttaacagattacatttttccgttcagcaggtctttgcagagatacgcatagtctggcagctggttgatatatggctcccagagccgcttgatttcggctaactccagcgggtcggctgcttccagtgcatgatcgttgccagtcatatataaaacatccgtagcaacatcatccaaacacttgccgcagagatcggcggcagattctatcctgataccggtatccacatagactggatttacgccaatcgtcagccagacatagcccaccttgtccgaccagagcaattcaaaatcagggctttgccgcagatgttccgcaaagacttcctttactcgctcaatttcatgtttctctttttctgtgtaaagcattttcatgtcctccttgacaaaaattttggtgcgtaccatcatcagtttagcacaaggcggcttagtttatcagtctgtcacatctgctgaatttcatttttgagcatacgcttgattttatcgctcatggtttctgtgctggtattgctgaaatggacatgaaccttgtaggtcgtcttgccgattttctttaccatcgctggcgtgttttccggcgctctggccgcagcagcggcgtctgccatctgcatagtacggggttctttgttcatagcgctcctttctccgaacgggtctgtgccgcccggtaaaaaatcaatcgtgcttactgtttacaatgtcttttgctgcctgtcgggtgacaccggcattttcttcccggaaattcttcccgtcaaagaggatcggcgcacaccgttccaaaatacggtcatagatacgggcgtgggccagatcaggcggatttttcagctcggacagtttcaagtttgttgtgataatcatgggtcttcggctgcgatagcggctgtcgatgacgaaaaacatctgctccatagcatattcggtactgcgctctacacccagatcgtcaatgataagcaggtcatattcgtcaaagctggcaataaactctgacctgtcctcagagaacatccctgtcaggcggttcagaatggtggggaagttcgtcatcagcaccggcacatcctggtcaagtagagcgttggcaatacatccggcgaaaaaagacttgccggttcccacatctccaaacagtaaaagcccgatattgctcttatatgcctctttccagttctccacataggcatgagccttgtccatcaatgggttttgcctgttatcattggaaaatgtgtagtcgtacagataacggtcttgcaggccctgtgcctttcggcgtttgatacgctccatgcggcgctgccgttcttcagcagccttgcgctgctcctcagcctcccgctggcactggcagatgcagtgcggcataaagtagccggatttcccgaagcatggcacaacggtctgcctctggccgccgcatttcttacagtgaatgagcccgtctgacgggtctatatactcgtcctcagccaattccacaccggcagctgccttgtcgatgaatgcccggatttctgcggtaatctcaatcatacagtttcatcctcctttacgctgtaatcacggttgcgggtgggcggggccgcctttttcgcgtcctcaccggcccagcgccggatggtggcggcatggctctgataccgcttaccggtagaggccatgtattcggacagcttttcgatgtactggccccatacagtgggaaaactggcctgcaagtctgccagttcctcgtccgtcaggaaaacattctggtaacggccataggcgcgggcggagcatcccttctctatctctctctttatctctatctctttctctaactctatctctatctctggtggacgaatgtcggacaaatgtccgccgtttgtccggggcgcagaaagagccttgttttggagcctcgcagcccgctttcgctcagcctcggtggaggactggccgattaaaagttcgatgttgctcatgtagaatgtgccgctgtccagcacttccacaaggcccagcttcaaaaagatctgcaaggctctctccacagtgccgatctgctggcgggtgatggtggcgatcatctgcgccgtgtaggggatgtcctcgtcaagctggagccgcccgccatgtttcagcgatttcagatacagcttgagcagaatgttggaatacagcacaccgtcctgcatactttccagcagcacgatggaatcatcgtcaaaatagttttctttgagtttcaggtaataatattttcggttgtctgacatagggttcctccttggggtttctcttgggattctgtacgcattttaaggctattttagggggcagaggataaatctatcagactgcctttgacacccccgaaaaaagccttgatttacaagggtttttcagcccctaaagcgtgacatttctcccgttgtttccgcttgcgctttgcggcgttgatccgcttcatgcgtgcggcacattccgggcagtatttggctcggttggaaccgggggtaaacagcgccccgcatacggagcatttcttagcattcagccggtggaacagtgccgtttccagttccttatcctgcggcaataccgccgcccgaaaccacctgcacaacagggagtaggaaatagactggacacagacacattcttccccatcgtccagggcgatacagtttccgtcgatgtagttacagcactcatgcaccagcctccgcactctgcggtactggcggtaatccatgacggggataggttcagacttattgttcttcataaatgatttctttcataaagccggcaacctcctcaaatgaatttattattaaatattcgtgcaaagtattgttttcttcgtgcaaatggcatatactataattgccagcagaaaggggttgatcgtatggctggaaataccacaaacatcagtatccgcatggacgcagatttgaaagcgcaggcggacgcactgtttactgaacttggcatgaacctgactacggcgtttaacatctttgtgcgccagtcgcttcgtgaaggcggcattccctttgaagtaaggctggaacagccgaacaaagaaacggttgctgccatgctggaagcggaaaggattgcaaaagacccgtctgtaaagggctacaatgaccttgacgagttgtttgctgacctgaaaagatgaaagaaaccaaatataccgtcaagtacacgaccagtttcaaaaaagactacaaacgagccatcaagcgtggcttgaagatcgagctgctggagcaggtcgtagcgttgctggcgatgggcgaaccgctgccggataagaaccgtgaccatgacctgtccggcgattgggcaggccatcgggaatgtcatattctcccggactggctgcttgtctaccgcatagaagatgatgttctggtgctgacgctggcccgcaccggcacacacagcgacttgttcggcaaataaaccgactgccgccgtatggggaaacctgtacggcggtttttctgtgtgcaaaagggtgtcgtgaaacgcgacgcacctaaaaggagtacgccaaaacgcggtagcccttaccgctccggttcccggtcgtgaggtttgtccagttcctgtcgggacaactgctcggcggttttgcggagccgttccactgctttcaaatcctcccgcatggctttcatggcaagcgtgtccgtctgctttccagcggccagctggtcaatttccagctgccatgcctttggggtgattgcctcgccgctgtctttcagttctttcagataccgggccgctgcgtcatacagaatcagttcccggctgtggcgctgttcaaactgttcccgtttttccggctttactttggcaaactgcttgtggatggacttgtactggttgtactgtttccacatctccccgcgctcggtaagggtagtgatccggcgctcggccttgacgatctttccccgcaggtcatagtaacggctgttcatatcagcgattttttcatgaagctgctgcatagactggatgccgtttgcctgtaaaaagctgaatagtgcagcgctttcctgcaaagcccggattttgccggtgcgggtgcggggagcgttcaactgctgctgggcttcccacaaggcggtcaagctgctttgctgcgtttgtggtttttccgcttcgtctttcgaccagagataaagacgggtaatgcgggctttgatttctttcagcagcttgttgtcggcggcgatctgccggtttacttcacccttgtcggtgcggatgccgcgcttttccatttggctggcggctggccccagatggacagagggaatcttatcaatgccctgccgcttgtagctgcggtggtctaccagggcgggatgaccggcggcctccaatgcccggttggtgcaggccgcccatgccgcccgccaaatctccacatttcctttgtcgttccagtcggtggtgtcctcccggtggttcttccagccgcctttcccgtccgggatacgctggccgttttcgtccaggtcgtatgccttgcggcactttgcgccccactgtccattttctttcagaggccggagcgtcagcatgatatggacatgagggttgccggttcccttgtcatggatagcaaagtcggcgcacattcctttgtctacaaagttgtccttcacataggcacgcacaagggcaagctgctcttcgccggacagttcacggggcagggctgcttcaatctcgcgggcaagctggctgtcccttgctttctcgatttgctccacgctgttccagaggatagatcggtctgcaaattccggcggcgcgtgggcaggcagcatgatctccgcatgaacaatgccgcctttccgggtgtagtcgtgggtcatgccgtcccattcatttgtcagcttggttccgctgcggtaagcagctgcggcaacagcagaacggcctgcgctgcgcttgataatactgacggggatatgacagaaatctatgggtggcacctcctttcggcggggatatttcaggctccgtggagccgaacaaacgcgaagcgtgtgtttggctgcgcggggcgcacaaggggtttggggagtgtagcgccccatcgcggacgaagtacgcaacagcccccggcagggcgcacagcaccggcaacggtgtataagtgcgccctatcccagaactcggatagggcgcattatcccagatattcaattatccgaggaaattcttaaatattgctgatattaaaggctttcaaagaaatatcctcggataatgtaatggctatttcagaaaatcaggcaactgattttccttctgattagcaggggtttccttttgatgtgaaaaccatttctcgttccaatctcggatatacctgttcacggtactctgggaaagctctgcgtaccgttcagtcgtagaaatcgaggaatgtccgagaaagtttttgattgctatgatcgggactccggcttctaacatatgtgtggcggttgtatgtctcatggtatgcggggtataacacttttcaagaaacatcttcggatactccgccttggcaagggcaacatattttttataaatttcctcaatgcaggagatagtcatctgcggatgtgtctggctggaaaagatataggcatctaaccgtccagttctgcctgtttcttccagataccgtttcaggaggattccgctaggtttagcgattacaatcctgcgggtcttattcccttttcctgtgattgtcagcttgtacagatttttttcaacaaggaaatctctgactttaagatcacagatttcctgtgccctggctccgcttgcatacatcaggtttaaaagaacctggtcacggaagcccaagcgtttttcagtgtcaggaagccggagcagggctgacacttcatcaagcgaaaaaataatccttggctggctggatgccttttttacaggaatcctccttacagcattcgcaaacacagtcgccgcttcaaaatttctgttctgtgcgtaagcggcaaaggatgtgagtgccgaaagccggaggttccttgtggataccgagcagccccgttctgtttcgatccatttcaggaaactgtcgattgtttcaaaatcgagatcctgaaacacgatttctccggcatctttctttttcacttgataaacatactggaacagaagccgaaaagaatgcttatacgatcggacggtgttaggagaaagacctgatgagagcggcatatattccgtaaaaaactgttccagcagaagcatgaagtcgggaagtttatttttcctcatcgcccacctccatgaatacgctgacagcatagtcttcaaacaattccgtgtattcggggaacatgtcgctgctgaatttcaggtacttctcagtctcgttcatgtcatggtgtccaagataaacggacaggaacggtacagaatcatttaccggacgtccttttttctctgcctgtacaaaagaatggatggcaaagtaatgacggaaacaatgaagacattgacctctggaatgagcctttccaggtacacacaggttggtttgctgtaacagcttcctgaaccgtaatccgaaagttccttttgtaacagctgccccttttttcctgaccgatggaaacaggtggctttccggctctgttttgattgccatcgcaatgcagtacttttccagcattctggttaatgttacatccatcggaacgacacgctgcttgttattcttggcatggcggatcaggatagttccgcgggaaaagtttatatccttcaccctggcagcaagtggttcccccaaccggaatccgcagcccaaaagcatccgcagtaacatacagaactccatgtccatctgtcgcgtttgcgggtctgtgtgcctactgccccagctatcggcactggccagaagcatttgtatttcctcatccgaaaaaatatatgggacatagctgtctgatgttttagggcagtcaggcataaaaacactgtagccttcatactggagataccttaaaaatttccggagatagctcaccttgtcgctgactgttttaggtgcgttagtctggagaagtctgccaatccaacgattcactgtcctttctgagatttcgccggtattttcttctgccagcagtgagtcgaacgaaagcaggattctgcgtgtattctgtaaagtaccgtcactgattgtgccctggctgattgcaaggtattccgccagctcgtttttgaaaatgcttttaaattcattcatgacaaagaccaccttccttccagaaaaccggcaaatgtacctgctgcttccggtacagggagtgcgtagccccgaagctgctcaatgtccagactggcataagaacggatggcattttggtctgtatgtccaagagtttttcttacgacttcataagggatgttgtcattgaccatggaacttgcaagggatgcccggaaggcatgtgctccctgcttgcgtttacctggatcgattcctgctgtttcaatggcagtccttacaatcttagtgattgcctgtactgagatatggctgtaaggcggaataattcggagaaacacatatggactttcattgtcggcacgctcttcctgtaaatatctctccaaagcagtttttacatcgggaaccatgggaagttcaatagtgacactggttttatgctgggtaagcaggatcaggtccctgtcaaaatccagctctttgaatgtcatggatgaaatgtccccgcttctgattccgagccgcgtcgcaaggagcagggctgcataatcacgctttccgtgtggggaagtctggtctatgctgctttcgatttttagaatttcatctgttgtgtatacagaagggtatggctgcggtcttttaaaaagagggacaataccactgtaatccctgtcggtatgaccggactgataagcataccggagaaatgtccggatgtgggaaagataccacttgctgctgactgataagcatacggttcctatattttggggattcatttcctgcggtttcacacaaccgattctggttagggcggataaaaagtaatgtccaatcttatcatgaagatgaattgtactttcctgtagccccttacgtcgtccgtcttcaagatattccgacaaaaaagcatccatctcgggattcagttcctgatacctgcatgatgcaatgtcgttttcgtttgtctgttgacacatggttaaaacctcctcgttattttagtggctttaactgtaccatacatgaaaaacgttatccgagattttctgttcaaaacccagaataccaaacgacatttgaagtttacctcggataattgaatatctgggataatgcgcccttgtaaacaagggacttatggcatatccccggattttggcaggtttgcagtcaattccgcagaccccggaagataggacagggcaatcagaaatgctttgacctctgcgccggaaaggctggaagccagcgggaaaatcccctccaaaatggctccgcgctcaatcaggcggcgggtgcgaaccctgcgttcttcgtttcgttgcttgttctccaaaatcttcttgcggttttcaagctgccggatctccttcaggacttcctgccgttcttcttttgggggttgggctgtaattttttcgttcatgtcatgcacctcttttctttggaaacgcttatagattgaccgtccatttctgacgcgcaaagtaccggcgcagcctccgcagtgcagcgtggatggattttcccgcctgtgatggtgtgataccctccattgcggcaatatctttcactttcatacccagcatatagcgggcgtggacacggcgagcctgcataggcggcagggaagaaatggcttcatacaatcgccgtatcagttcttcgtattcggctaattcttctttttctatcagatgatcctccggcgatggctgcgcccagccgattgcagcattttcgattccatcgttacaatcgagggagtaaaacgccttataccggaacatcttgcgttctctggcggcctcggctctcttatccagaagaaacgcttcgacgatctcatcggacacctccacaaaaatgtcctctttgcaaaatggataatattgtttgagattgatggtctgcataggcacgccctcactctgtttgaaaaaggtcatcatagcagcggcgcatattccgcagaccccgacggatggaaacgctgaccttgctgctgtggacgccctctctccgggagatttccggctgcttgataccggcaatgtagtaggcgtgaacacggcgggcctgtgtcggagtggcatgagccagagccaccggcagagctgctatcaggtgcaggcgggtggtcatttcttctcgttccagcaaaatatcttccggcgatctgctgtgttccagtgcgtaattttccagccagctgtatgcctccagagagtagtaggcgcggtggtagactttccgacgctcatagttctccatctcccgctgggcctgatacatcgctgcccatacctcgtccgtaacatccacaaactcgtcatgccggtagtggggatacatccaccgcagattgattgttttcataggcttacctcctgaaaatcggagaggcgggcagctcgtccgctgtccgcccctcgctgagataagggaaatgatccctttcacttggtagccagaaaacaggtcattcgttaagcctgctctcaaagaaatttataaatttttttctgaccgcctccacactttgatacacagccactttggagcagccgcacagcacaccgatctctgcaaggctcagcccgtcaagcgcatagagcaggaaccggcggcgctgggcctcggtacaggtgtccagaactgccatcagctcatgtagcgtttccatgcggcaaaggtattcttccggcgtttcgccgtaggctcctacaccctcggtggtaatgatgtactcgtcaaactcccggccatcccaatgccgccgctgttcatggaacaggttctccgttttgtgatctgcccgatcaagaaattcatagacttccagcgtgacctccacggccacagcttgtccgttataattgatggtaacttccatctgtccttcctccattcagacttttttgggaaaatctgaatggggtggtggggcgcggcaccggggataaagttcgggccatgctgacccgatgttccggctccatagggacaaaaaagcgcccggacggcataaagccatacgagcgtcatggaatatattttgctgtttaattacatggtatagtgcatacttctgaccgcattgctccgctgctgggaacaggctttttttagctggtgcaggtcatgggtactgtgaaaaaaggcaaacatagacacggcggcatcctcctatgtgccgccgtggatttacacggtgttaggtcgtcgttggtttaggataaacgaaaagaaacggcggctctgaaatcaaagccaccgcttcataggcgcgtggaaatgtgtctgctttacgacggctttttttcttttgccgtcgtccggcagaatgttactccatattcaattcaatgcttccagtgaaattttcacattcaatgccgatatagtttccaccttcagggagtgtaattgtatcactatatgttccggttgtttcaagcaaagtgacttcttcatcagctccagaaatccaaaatacttttgcagttccatccgtaacctccagcgcgcagtcaatagacagatccttacccgcttcacgctttatggaagttccgccgaacaaatactctgtatctgaaaaatcctcatagttggctgtatagcttcctgtataatcatcaattcctttttctttcgtaccttgtaaggatgaatttccggtaagtgctatggaaccagcagactgaacaatattgttatactgatcgagaacttcatcttttgtacaaccggaaagcacagaagcgcccaacagtatcaagcataatgatagaactattttcttcacaggtatcaccttcctttcctgcgtacagcacgctttccttttcccttggaatttgcctgtttacgggattttatttctttttgttactggacatcagtaacaacagcaccgcccagagaaccatgatgccaaccccaatgactgccagcaaaggattcggggctgtggttgttccggcatatccactcatgtcaaagcccactaaaatcagcgcagcagaaaacggatagatgctggcaaggataccgcctttgaagaacagcatgctatatccaaggaaaaacgccagaatggaacctcccagatatgcccctcggatctgcccaaaaatcaagatcagcggcatacagaccaaataggtcgtcagagctgccaacacgatctgtgtacctccatgaaaaaacacttccactgtcagtcccgataatccaaccgtcaatccagtaatcaaggtaacgccaacgctgtatattcccagcaggactgcaaaaatcccgacccaaaagagcttagctcccagcattttcggcatggaaacaggaattgtcatgatgtttttcagcgtatcatgggtggattctctgtcaatcagccagctgccaatcatcaccagtgaaatcggaaaaaacatctgcgtattgccccagacaacattctcaaacagagtggaaaaatcatagtttggatttcggtactccgtctccacaatcagctggctcccatattgcaccaacggacagagtgcaagcgccaccagccccacccaaagtatttggcaccggcgtagcttgagcaattctgcttttaataaattccacataattacacccccttagatttcctggcgccggtaaaccaacgcaatcagcgcaagaaatacaacggcttccccaacaatcacaccgaacacctgaacaccattcagaaaatacggactgatccgttccaacaagtctgccaattccgcactggtctggctttggtcataaaattggaaggtccagcggaaagccagcggtcccggaaacagggttccgatattcaaaccaaaaggctgtgtgaggaacgcatcgctcatcgaaaggatataatttgcagtcgtatagaaaaaggtaatcacgaccgacacgatatagtttttattaagaagaacaacgagcaggatacatggaagtgcgcctacccacataatcagcccttcttctatcccaacgccaaacaaggtccaaaacccaaccggctcccagccctgaaacagcaaaaccgcaagatttaccaatcctccaactgccataaagccaacggcaaacaatagcaaaaccagcatcttggacagcaccaacttggttctgtttatcggtatggtaacaaggttttttagtgtgtcattgtccagctcctcaaacagcagattggaagccagtatcacaaggagcggcatcaaaagcaaataagcactgagctggaacaggctggacatcactccatttacagcatccacatcagtgtttacatctgccagaaagaaagcataagccaatggcatgaaaacagaaagcagcagagaaataaataccaagggcttccgttttaatttcaaaaattcgcatttgattagtttaagcaattccttcgccccctgtcacacgcttgaagtaatcttcaagactttcttcacaagtatgcgcctccgatacctccaatccgttttctacaaaggcagttacaattttccccacaggcagatcaaggttgtgcaggcgcagattgtggtcgtcctgtatggaaaaatggttttcatggaaattgcgttccaaaattcttgccgcctgtgcagtatcagagagtgtaaaccggatatgcttactgcttttttgctccagttcagcaaggctttcttcttccagcaatgcgccgtggtcgataattccaatatcgtcagccagcaaggaaatctccgaaagaatgtgactggaaatcaaaatggtttttcctcttgcgtcgcaaagctcccgaataaaggagcgtacttctgcaataccgataggatcgagaccgttgatcggctcatccaaaattaaaagttctggatcgtgcataacggcaagggcgatggcaagccgctgcttcataccaagagaatactgtgaaaagagctttttatctttgtaaggcagtcctaccagatccagagcatctttgatggcatgattgtttggtacgccccgcagggtagcaaagatacgcaggttctctgtgccggtcagattgggataaaagccgggagactcaatcaagctaccaatacggggcagcaatttcttttcattcccctgcaagggtttcccccagattttgacctccccggaagtcggcttcgttaagcccaacagcattttcatggtagtggtttttccggctccgtttctgcccagcagaccataaattctcccacgcttcacatggatatttaagtcagccacactcttttgtgagccatattgcttcgtcagattttttgtttcaatgatgtaatttgtatccatattcaaaacctcctgttctgtaaggtattctatcacgccaaccttgcattaaccttgccgcaaccttgcattaaccttgcaatttgaaatccggcaaaaatgacaaaggttcccgccataaagacgggaacccgcttaaatctccaaaggaaaaagcaacataaattcagttccttctcccggaaagctttcaactgttatgcttccacccatcttttctacaagctgatggacaatagaaagaccaagtccgcttcctttttcggagcgtcctttatcacacttataaagccgttcaaatatgtgtttcaaatcgtctttctcaattcctactccattatccgccagcagcagctccatgttattttccttctttgacaggacaattttgattttgtctgcatggctgtgagcgattacattttgaatgagattgttgacgatcctcatatagctgtccatatccaatcttacccggacaggctgttcgggaatatcaatgtcataatcaacctgtttatcctcaaaaatcggtatccagtcaatcaggatatttcttgtcagctctgcggcctcaacgctctggatttccaaagcaaactcattggaatttaacttgaaccagtcaaagagcacatcaatatattctttcagatcatgggctttccgtcgggcggtttcaatataatcatcccggtcttttcctgtgaccagtcctttgtgtgcagcgtcaagatacccaatcagagtggtaaggggtgtccgaacatcatgggaaaggctcgtcataagctggcggttggtttcttctgtctgccgtacagttgaaagtctgctttcataggacacaacaatctcattgatttcataggcaagaggtgctgtcaattcatttgttgcagacagaatacgccggttgccatttccgtttttcacatcaaccagcacatcggtcatttctgcgatttgtttttttacgcgccgaacgagaacgatggaagtcagcacagccacaacagcaatcacaatggacaagaaaacgatgatttccatattggctatacctccttattaaagcggtagccaatccctttgaccgtttggatatactttgggcttgaaggattgacttctaattttttacgaagccggctgataatcgccataatgttactgtcatcatagaaatattcttcgccccaaacttcctcataaatctgctgttttgtcaaaatttttccttgatgctttgcgcagtacaggagcagatcaaattcctttggtggaagttcaaaagtgccattttccgtcgtaacagaacgattttcaaggtcaatttgcaatccatcaaaatccagtttttgcacagctccggcttgatgattaaagcgggtgtagcggcgaatgagggacgcaatacgggcaatcagttcgtccatatcaaacggttttgtcagataatcgtccgccccggcccgtaagccccgcactttagaaatgctgtcatttttggatgtaaacatcaaaatcggcaggctgttctctttgcggatttcttccagcgtttcaaagccatccataccgggcatcatcacatccagcaccacaagctgatactcctgctcttttaatttctgcaagccctcttttccggtattacaaaaatcggcttctatatgttccgattgtacgctgcgtttaatcaaagcgcacagttctctgtcatcatctataatcaaaattttattcatggcgtagttcctttccttgttttgtccggccatcaagcggcttctccgcagttttagggagcagccaaacaccggccattttcacagcgccggggatacgcccaccggcacaataataatttaccctacgaggtgtcacgccccatttctcggcggcctctttcaatgtcatatagtccatttcgcacctccacagagtacattatagttctctttctcgaacaatgcaagaaacggaatgtgaattataaacttcaaccaacctgcatatagcaacattccacaggcaaagtatgaattatacaatgtaactgggtgatgttatatggcgaaagttgaagattgtcccggttttgaaaccttcggcgcagatgtcaaagccgcacgagaggcaaagcgtctggcacgaaaaacattggcagaaatggttgggattgaatggcggtatcttgccaacattgagaatcaaggtgcgattccgagcctgcctgtgatgatccagttgattaaggtctgcggacttcccgtggaacggtattttaacccggagatcatgcgggaagaaagcgaacagcggcaacgagtcagccacaagctgaagctttgccctgaagaatacctgccgattatcgaaggtgccatagacggggcgctcaaaatggaacagactgcgaagcagaaggaggacgcataatcgcggcctccttctggcgtttctatatcaagtttcccggcacttttcccaaagttcccggcacctctgctggatttctccggtttctgtcacagtcagatcgcggtcatttccggtaatcttatcttccagaaagttggcgtatgtatccagcaaggcgtttcgcaaatcctccggagttttctgtatttcggcgctgtaccagtcattccggtgaggttcccatgccatcaatgtataaccgtggctggtctgcaccacctcatacagaggatcatcatccagatatgcctgaaacacttccagaaccttttcaaaggtcagcatttcccacacctcccattcaactgcaaatcagttccctgattaaaatttcctcaatctgtgccgttaatgtgttcatcagtcctacccagcgcataggatcacaggctttcagttcctcagtgacacccgcagcctccatcatgtgaggcaacatggtgtccacgcgctcctgcgctgtccaatcaatctctaacaggtgcggatacagtttctcgctcatcagcagttggttgtagagaataggacggtgttccttcaggtaggactttcgcatcctgccgtacttgccgatagaagtttccggctgttcagaaagttttaggttgggtatatcataatctccacaacgaatgtaagtcaacttactcatattcatgctcctttgctccgtgatgattagactgctgcgctggctgctatgctgcctttgcgcggttcttcttttggtagctgcccgatagtagaaaaaacaccttttttcatatcctcagcccggatcagggctttcttagcgtccatttccgcttttttcttcgccttgattttgtcctcataccgtttctgtgcgccgctggctttccgcttcaaatagttctgatggagcctgtccttgcgttcttctcttttccgcaattcttcctgttcctctggggttaaaggaaccggctgtaaggatggtggaatatagcgtcctaaaaaattaaagtagatttcaatttcctgcgtggtatcctgactgccttttcgggagcgttcatggacaaggattttctctacaaactcgttgagcatggtatttgtcagcgtgtcaaaattctcgtacttatcaatcagggctataaatttctctgctgatttctggctctgctcatagccggtaacagccttttccaactccgcaatttcaatctcaagtgcgtcctgctctttggcatactgtgcatcaagcgccttatatcgtgtatccggcagcttgccgagggcgttatcctcatagattttgcaaatcagtttttccagttctccggctctcttttgggcagtagccagatgcctgcgctttttcgatatatcggcactctgttgagcaacctgcgtctcctgaacagtgtgaataaattccgtccggtcatttctcgaatattcagcgatagcccggagtgtgtcggaaaccaatgtcagaacagcactctcattgatacggtgttgtgtaaggcatagtgtcccacacggaactttggtataattggaacaggtatattgagaaatccgcttgccattgttggtgcggtggacatacatcttgccgccacaatcggcacaatagagtaagcctgtgaggggagctgcttcgccccagccgtttggataacgccgtacattgctgcggattttctgcaccagatcaaaggtctgctggtcgataatggcttcatgggtattctcaaagatcgtccactcgtcctcagaaacatagtggcttttcttgtccttaaagtgcttgcgggtcttgaaattgatggtgtgccccaaatactctcgttttttcaaaatgttcacgatggtagatgatccccatccataggggtctttgaccggctttgaacggttcacaccctcgttgaagcgggcaaggtgtacgacgggaatttcaatccgatctgcggataatttgcaggcaatctgataaggcccatatccctccagcgtgagggagaagatacggcgtaccacttcggcggcttcctcatctaccagccaatgctcccgtttttcgtcccataagtagccgtaaatcacagtgccggtcaggtgcttgccgctcataccttttgccttaaacacagaacggattttcctgctggtatcacgggcgtaaaattcattcatgatgttgcggaatggggtaaaatcgtcatcgcctttcagactgtccacaccgtcgttgatggcgatcagacgaacaccgcgttgccgcaaaacctccatgacctgaccgaccttcagatagtcgcgccccaaccggctcatgtccttgatgacgattgcctctacacgccctgcctccacttcctccatcatcgccaaaaatccggggcggtcaaaacgggtgcctgagataccatcatctgtaaagtgcgtagggtttggcagcccattccggcgggcaaaatcctctaacatctgtttttggttggatatggaattgctctcgccctgtaactcgtcgtcccggctcaggcgctcgtacagtggggtaattttttcatttctcatggctgtacctcctgaaacaaaaatgctctaagtgattgcttcactaaccatgacaaaatcatgattaagaagtcacttagagcatatatcacccgccgcctgcttgaataccttatactgccgcagggccacactttccggatgctcatgttccatcgccttaaacagcaggtccaacggcgagatgtattcgtcatcatcctcccggacttcagcgtattccaacacgcgcatgaccatggaaaagttctgttcatcctccggcgcttcctggtgcagcatgaggatgatagcttggagcagagctgtttcggacttcgtccagaacgggtcggactcatgactgcccttgggcgtggttgcctggatcagcgtattcaccagcttcagagcatctttctcgtcccgcaggtagcagaaggggttatagccgtcagactgttccaaattcacgagattcagcacgcggacgtcatagcctttctttttcaggtatccgcccgtgtcggtcagaacttccattttcgggtccgtgatcacataattggtattggcctccaagatgttgggcttcacataaccgcgggtcttggccgcgccgctgccgccgatgaccagcacattcaaggagcgccggtgtttgtgggtatccagccccagccgcacatggcgggtcaggatcttattctgcttttggcagaactgcgcattgacctgcctgggcgagccccacatggcggagccgtgttcctcgccgtcccgcgtcctgccgctctcggcgtcatagatgcacagacccataatgtaggcgccagtgcaaatgaggatggtcaacaggctcttgtccgtccattgaatctggaaagggtgctccagcgcggcggccaggttggagaacagatccggcaaaccgccgccaagggattgtgcaatgagcaacgccgcccagatgaccgggatatagaggaaaaggcgcaaaattaggttgctttgcttggatgtttgtttcaggcaattcacctccgggagaacaaaatagcagtcccatcggcggatcgtgtatcgccaatgggactgctttgggtgatctataatacttatttcattttaccatttttactcttttgccgattttttgttctggccgaggcagacttctgctgctgatccaactgtgccttgtagcccttcagacgttccaacacggaggggcgttcctcactcgtcatccggctcccgtctttggacgaggtcgagctgggcacggtagcgggcaagtcttgtcccgaccgagatcctttttttggctccacctcctgacgttggcccacaggcggtgtcacaggggtgttctcttgggggcgctgatcctgctcgacttgggttgcagcctgcctttcacgggcttctctggccttggacggggcttgctcccgtggaggctgctgtgcctgcgctggttgaccgaggtaatggatgcgctcgaagatcatattcgctctgtcgatctccgttaccggcatgatgacatccaccaccttgccgtgaccgtccgtatcccgaatggcagagaataagattttctgctttccagccttctttttgaatgcctgatactgctccggagacatggcgaaccggcgcacgtcgcgggtctctttcagcatcttcgcgaagttgactttgccggagatcgtcttatggttttttgccagtgccagcgtcagcgccagcatatttttaaggccggaaccactcagccggacagctacctcaccgccggagagcatcatgcgcaccaattggtccgccgcctcaccgcctccgatgttcatgtttccgcacctccttctggtgttcttctgttctttgaatgtcctgttccatgacaggcacttggttttgtatcttatggcagagcttcagcttttgccgctccgtgcggatctcgcggttcagctccgccaactgttcatagatctccgccttttcttccgtcagccggttcctgggaacgccgctgctctccagcagcgccaccgcttccatgtaccgttcaaattccgtctccatgccggtcagaccttcttcatagagcgctttgctgggagccaacgcttccacatccgtcaaagccgtatacagtttttgccgtctctttttccgcacattgaggatggtacgctgcttgatgagtttggccagcgatttctctgtgcgggtccggaaggcatccatatccgcctgggtgacgatctcattttcccgcagaaagtcgaactgtgtgcggtattgctcaaagcgcatgacctcccgcctaagatgaggcgtcatgcggggcgggtactgccgctgcccgatcttacccagcaaatagagataatgcacatagagggcaaggaagccggtgtatttcggatgcgccaggtatggccgatacttaggccgtgagagcacagcgggacggctgcctgcttcaatttccgcaagatttccttgaatagcaacacggataccatcctccgtgaacagcgtattgcgtctgccgggatactggaatctctcctgtccccgcaggcgaaaacccagccgatcaccgtggtggatctcatatcccatgtgttccatgagcaggaagaagtgtccgagatcgttggcatcctggatagccgcccgcaaatccgcttccagcatggagcgaaaggtcggctggcccttggactgccgcagccactccacatagctgacggctttggcaggctctcccgccataataacggacaagccatgctcccggcagagccggtctgaggtgctgcggatctgctggtagtagctttgggcgttactgtggtatttttctccggttatggaatttacggaattaaacactgtgtgagcatggatatgttccttgtccacatggacgccaatcaccgcctcatagtctgccaaatgttcctgtgcaaactctttggcaatttgcaatgccacctccggtgtgacctctccgggttggaaggactggatgatatggtaatactgcacgccatcctccttaccaagttctcgtttggtatccagcatctgacggcactccataccgggatcgcagttcagataggcggtcagaattcggtcatctgttttatctccgttgagtatatagtggatgcctgcatcgagccgcccctttctggcaaggatctttgtgatggccattactttttcgctacctgatacatgagttcatacacacggtccagcagatacagtcctcgtttagcatcctcaggttttgcgattccggcgttcacgctgcgggcaatctggttgatgttgtttccgatgtggtggatctccgtgcgcaattccttgatttcctgagaagggcgcgccttgaccggctgtccttcaataagccgcgcaagatatgcccgttttgtcaggccgctctgcttggcctgacggcacagcagttggtactgttgctgcgtcagttcaatgtgcagatggtgtttgggttcttttttggccacgccgcactcctttctgcggcctgtggccgctgatcatccgcccgcaggcggcattggggactggggatacccccagcaagcgcgctaaatgtacatttgcgctatgcttgcgccagcgccgccacggcggcgttggctttcgccccgctgcgcggggctttgttttcaagcggtatggtaattgcaatattgggcgggcactgcccgcttcctcgtaaaaaagaaatcatctctccggggtcggatgccggcaaaggtacttttcgcttgcgcgttccgtcggaataccatccaatgagagagcactcttttcaggaataaatgccgcatacctggcatatccaaaaccttcggactccaccagcaggccggtgttcacatctcggcaggtcacgaacagacagagaaatgtttcagtttttccatcgaaccccatatccgacacgttccgggatatgaaggaaacatcccgcaaaagctcgttcatgtagcggcggtactgctctttcggcagttcgatcacttttgtgatctggaaccgcgctttctccgggaacggagccttctcgagaatatcccgcacactggctgctttccgataaaaactcgcaaaattttctaacatacttctctccttgtggcagggtgttttgtgaacacccttatagaaaaagcagggtgttttgtgaacaccctgctcttgaaaaaacgtttttgtttatttattaccgtgcctcaagctctttggccatttcccttttccgcagtttttccattgcaaaatcaaggatgcgctcttttcgtgtctgcagcattgtcttatagaactgcttttgcagattcgaaatgaacggagtctcatccacgatacggaaaattgcatccatgttgattttgggcagcatccgcttcaatgctttgttgcaatccgcattctccaaagaggaaataaaatcaaagtagttgatttttttaccattgaccttaatgctggaaagagggattgagaaagtgcgaaaatctcgttctggctgcttatctatggtgtctcgcatgatggcttcatcagcctggggatacaggcagctcccgcagtcatacacaggggcaatggcaatttcgtctgtcgcggtattataaagaaaaccccagtttccgttgtgccgatcccaattcccgatcagcgcatctataatgaatacattccaaaaatgctgctgcaacaacgcgggagggaatgctgtctgatcctccatggcccgcataatgtcagacagttctgtaccatacccgctgtgaccggaatcgatcaccgtgtttttcagtgaggcaaagtcctgcaacacaattccgggagaggtaaaatccctgcaagcaacaacaatcttttttacgccattttttcataagtgccaaggagcgtttcctgagccttgatcccaacgctgttgaaaatatggcagccgatatactcggtaatgcaactgttagcataactcaagtctttattcttgggggcttgtgcggggaacttcagcatatactgttcgccttgataaattacagcccgctttgcgccgtttgcccctgcatagaacttattgcgagtggggaggtctgtaaagtttatcaagaggtatcactctctttccatgcgaagatacttttcgcgcaaataccatgcctgctcgggagaaataatccgttcgacttcggctgagttaatgtccgcgttcagattgcaccagtagatgtcccaatgaggatcccggtttccgccgtctataatgtcccaagatttttgcatctcctgaatagaagcctgcaaatcatcagggagtccgcattcaagatacgactgatccaacggctttccggtttcctgatcatattgtgcgtgattcataactaattcctcacaatgctctcttactggatcgtttttattataccgattttccggcattatagcaagtccctttgccagacagcgcatcaggtcacgcagcttcctccagctctgaacagattctttctcttgccagcttggcataggtgtcggtcacctcaatgccggtggcggaataaccctccagaacagccgccagcaccgtggtgccggaaccggcaaaggggtccagaatatggccgcccggttccgtgatctttacaatgtcccgcatgagctgcaagggtttctccgtaagatgaatgcggttctgcggattgccatatttgaacactcctggcaggcagggcaccggacggctgataggcatatttccgttggaaccccagacaatgtactccgcctgctggcggaagcggcccttctgaggacggctgttgcccttatcccagacagcggtaccccgccagatccaccccgcccattgaagggcatcggtggctgcgggaagctgccgccagtcgatgaacatacatatcggcgcaccgagcttgcttgctttcctcgcctcatacagccactctgccgcccagcgggtccaggagcgctggtccttggcatcgccgtcaaagggaggtggcgcgttctccccatactggaatacttcctggcggtggacttgtttttctcggattgtgtccggcctccggaagcatacgggggatcggtgatgacagcatcgaaggtgttgggggcgaacccgctcagcaccttcagcgcgtcaccttgaatgatctcccatttctggttatcgttcatgtgtgtggtcctccttgtttttgttttttgtgggaatgctgccggataactctgtctctacatactcgctgatgattcccaaggcttcctcatagctgtggcagtctccgcccataattcggttttgcatctcttttgcctcggctgtcataccgttttgccgcagtgtccggcttgcaagaccgatgagattgaaaatattgccgttctgcccgacaagagggcaggacggccttttgcgttcctgttccagcgttatcgctccttcctgccggaacgcctgggtggcgtccggccaatggttttctgatccgtcatcatcggaattcccagcttgctggcatggtggatctcatcccacattccttccgtccaaacaggcccataaacattgagctgctggcaggattccaacagttgcagggacatctcacgcgccttggtatcctgctccgggtcgtttgggtccgctatgggtgggaacagcaggtgtgggcaaacggggatatctccatccgcaaacacctcccgtgccttctgccgtgcgaattcaatattggcttccacatcaccccgcagcggcgcgcagatgaacaccagcttggggccggcctgttcccgttccggcgtccgttcccggaacacggacaggtattgcccgatggactgccggaggacatcgtaatccgcagccgagggatgataggcataccagtccacatctccgcggtcatcccacaggtgaggcattacaccgctgcggaagttcgggttgccagggacaggctttttaccccagacatccttgaaccgcagcattgtccgatccactaccccctccgtgcggttgagcaccgtgaggcggatggcgtcatattgattcgcaacacaggtggaaaggaactctgcccgtacccgcagatccttcccaagttctcctacacagacacgtccggaatactggggatgatcaatgaggtcgctgttttcaaacagctttcgcagttctctttcatagacagtcatcgctccatcccccatttctttggttttttctctttggcaggcggcgtttggctggacgcaaggcactctctgtctctaccccggatgacactgcggccggtgtccgtcaggacaaaggtatcctttgtatcattcaggatttcttcccctggcaaaataacggcggtgccggtaacacggacatccccgcgcacgcttccgtacacctgacagtgcccagacagcaggggcgttccgaactgactcggcacgctgatgatctgggcgcagccggacacacgcgcactgccattcatcacagcgccccgcaggtaggcgtcatcctccgcgcgggcatggttggaaagaacagagccgtgagatacataggcattgtcacaagcaatggcgttttttcgcaggtaagaacccatatccacataggcgtttcccgctgcgatggcatcatcgaagatccaggcgccgtcggacgggtcggttgccagattgctttcgctctccacaaagccgcccagatcccccgctttcacctggtcgccaacatcccgcagcgcacggatgcggtggaggaagggatattcttcgtgggtaatgtcagtgatttcatatttcaaattgctcgtttttcatcaactccttcattatgccgcgctttcaaaaagagacttctgggcatcctccatgcggaaacgggcgtcgatatctgaaaatgtgtctgtgcggttgaatttctcagacacctttcccggcagggcctgcagttccagcatccgttcccacagttccgggtgatgatcatagagatgttgcagttcttttcgtctggcgttgggacagaaccagcagccgccccggtcggtaaacgcatacacaggagaaagcagccctgccttgcggcagagctgcttcgcatcttcctctgtaaacttgtattttgccagcaaggacacctgttgattcttcaggcgtgacagccgtttttgctcatcgtaggcgatgccgatatactgcatcgtgtcggcaggcaggctcttttgatgccgacaaatcggtttgattttgcagtcccgctggacataacactttccgcagattggaaaggcccgcagcatccctttcttggggccgcgggtgaccgtccctgtgaacaggtctacataggttttctccgcacgcagaacacgcaccttcacccccatccgctccagctttggaatggcggtgtgatagataaagtcccggtgttccggcacctcacctgaaatggttttatcaaacatcacctcgcagtagacggcttcgtccagcggttccccatgctccagcgccagcaaaatggtggcaagactgtccttaccaaagctgcagctgacaatatgaagaggttttgatctttcttttgaaatggtatcactccttgtttttcttattgttccggctatattgtcagccgggtgattttttggtataataaaaaatattattttcagccactatctaaacaaaggagaaaacaacatgaacaagacggaacttctcaccgctatggcagagaccagcggccttgctaaaaaggactgcgacgccgcactgagcgcattcattgataccgtggaagctgctctgaagtctggggacaaggtccaactggttggctttggcacctttgaggcaaaagagcgtgctgcccgcaccggtaaaaacccggccaccggtgcgaccattgaaatcgccgcttccaaggctccggtctttaaggccggcaaggcgttcaaggacagcattcagtaatacctgacagcgagaggcgagtcctctcgctgtttttttatcagcgggcggaaacccctgtctccttggcgcggcaggcgctttccagcacctccgtcatatccgtctgctcccacggggcatccgcgtgggtgaagtgtccgtagttgcagaatttgcggaaaataggtttgtccaaacccagcgtatcgatcatgccgttcggcgtcagctggcacaccgtgcgaacggcctgctccagtgcagcattggagtacttgccagtgccgtgggcatccacctccactatgacaggcttcgccctgccgatggcgtaggccatactgacggtgcagcgttcagcaagtcccgccgccacaatgttttttgcgatgtagcgggccatgtaagcgccgctgcgatccaccttggtgccatccttgccggacaacgcgccgccgccatgtggtgcgagaccgccgtaggtatccaccatcagcttacggcccgtgagtccggtatccgcttcaaagccgccctccacaaatctgccggaaggattgatgaggatctccgtttcggcatccagcgggaagtcctgaaaagcgggctggataatatgtcgcatgaccgcatggcgaagctctgccagctccacaccatcctcatgctggcaggagaccactacggcagagacacgcttgggaacgccgaactgatactccacagacacctgcgccttaccgtccggcttcaagccgggaatcgtgcgcagctttctcgcctgggtcagcaggcgggtgagttcatgtaccagcactaccggcagtggaagaagctcaggcgtttcatcgcaggcgtagccgtacacgataccctggtcgcctgctccggtctccgcgccgctattgactgctccggcgatgtcggggctttgctcgtgggtgatcacctccacctcataatcgctgccgccatatccggcttcccgcacggtgcggcagatgacggcagggatgtccgggagccacgccgccgtgatctcgccagccgcgatgatcttacctgcggtagccatgacctcgcaggctacatgggcggtggggtcatgctccaggcaggcatccactacggcgtcggcaatggtgtcgcagagcttgtccgggtggccctcagtgacagactccgcagttaagacatacttatctttcatgttcgtttttctccttattgcattgttttttatggtttccggacggcacaggaacagaaaacaccatctcattggcgtatttctttcgatacttttcgatctgctgctccgtcagggatgtaaaatcctcatctccaattccgactacaaaaaaggtgccgcagacaatgtcatacggcactccggattcatctgtcagggcacggttcataggcaatcccagaagcttgccctctccgtgacagacgagcgcgaccgggtcatcgaacgggtaaacagcctcaatatctccacctacgatccgctgcatggattccaggctgccgtcgatctcctgtacagtgggcgttttcatcggctccaccacaagaatggtcattttttgatgattgataggatcgcctcctaaaaaaaacaagcggcagcagcagtctgagaccactgttgccgcgaaatgatttgattatttttttgttttcagagccagcgtttgtgttttcagcaaagcattctccaacgctctatggtcctcgtgatcctgccaccagtgggggcgcagaaaactcagtgctttggtggcccagatgtagtcatcccgccccagggactcctgcacgagtccaagtcggaacttttcgtagttctttcgtactgccgcatctacgctgtcccggttcaaatacagttccagaaacccacaaaggacagccgcttcctccatcgtataaaacactacgacacccctttcacacaaacaggcatcattgtagcacatacgaagggataatagaagccctatcacgatttccatagtcaagcgcgccaatctgcgcatctccgcagtgggaatgaccagccgaagaatgtccttatgtgttccccacctttcgcttttagggcaaaacgattccaaaaacgaggaatggaattcccctccattcctcgttattccttgtctggcagataagtcactatatcagccaaagtacaatccagtattttacatagcgcgtccaaagtgttggtcgaaacggattcattcgctttcagcctccggatcgtagaactactgatcccacctttacattgcagcgtatatgtggtcgctccacgcttttccatcgtttcccacaatggggcgtatgagatcatcccggttcctccctccgtttcgcgctttacatatcttcattattgcctataatgaacatatagcgttataggcaatattgcccatatcaggacgttctaaacttgaaccgcaatgggaggaaccataatggaaacaaaagtatgttgtgttacgggacatcgggatattccaacagatcgggccgtctacgtagagcaagcgcttcgacgtgaagtcctggcagcgattgaggatggatatacccgcttcatctctggttttgctgaaggaacggatctcatgtttgcggccatcgttgccgagcaaaaggaatacagccccaatctgtatttagaggcggctttgccctatgcgggcaggatcaaaacaaaaagcaagcaatttcacgatttgctgcgaatctgcgatgaggtcacggtcgtatgccaagaatataccccttcatgctttatgcggagaaaccggtatatggccgtgaagtcccagcgtgtgattgccgtttatgatgggcgagatcgtggtggaacgctttacaccatgcgctatgcccatacgctggagaaggaggtccgggtaatcgaggtatgaactttgtgtgatttgggcgactcaaacgttgcatcgcccgacgattttatgcccatcttacgaagttacctctccggttttctggtttttgggtttttcccattcttcggcctctccacttttcctaaccagatttcgtcgatggtcctgttccacgcttcctccagcgattccaccggcaagccattggcctcgaagccttgctggatcgcacggtaataatacggagaaggcagtgcgggctggcggctcatcggttctgccatgatataagccatgacggaaacggctgcgtcatctgtggtccgcacagatacctgctccttggtgtagtggcgaggatagccttcgtagcggtccagcgcctgttcagacttcggcgtgagcttccatagcagaccgtggacgacgctgcctttcttgggagagacagtggcaaagccgctgccgcggaactgcaactcatagttctgcagcgtcaccggcccaacgagctgggcgtctggacaacgatgctccatctgttctaaattgatattgctgccgtaggcgaaatacagagtttcttccatcttagtcccccagcagtctgagtccgccgattctgtccagatggcggaacatggcctgcgcctgcgtttccgtatctccatccggcagtgggcagtccattcctgtggtgcggatgacattgctctgtaaaaaccagatgtagctctcgatgtccgggaactctgtgggatcaaaggtctggtcccgcagacggcccatgatctccgtggccgttccctcatagacggtttcttcgatctgtatcttcaatggcttcacctctccatttctctggattttttcttctttttattggcttcataagtatccttgtcatagcgccatgcccgatcaccctccagattggccagcagatgattacgggtattcttgaactcgtcaccgttgagtcccagccgcaccagccagacacggaaggtaaacagttcgttgtcgctatgggttttccgcataacggtgctgcgctggttaatggcttgggcagacatggcaaggcataaattcacataggccgcgacctttccggcatgaagcgtagagttgaaacaacgccactcaacggttcctctataaaacacagagtgcagattcagggcataatagcgcgtccagttatagtgttctcggtcagagatattcccttcataccagatgctttccagcgccgtgagattttttgtttcgtcagaggagagcttgcgtgcttcctttagcattggctcccgcaccttctggcagtattggctgacacggcttgaatttacctgcagtgctttgaacaggatatcctccttggagtacataatgctcagaaggtttttcagactctggcggttgtggttggcggcgtccacatgaacatggataccgcaggagtggttgactttggccccgacatggcgcacctgacggacacactcctgaagcctgggtaactccgcgtaagtgagttttggcgtcaccatctcaacccggtattcgatgttgctggtatgcatatacccgctttcagttttcatttccgtaacaatgctggaatcgctcataatgctccacaccttgccatccgggtctttcacgctccatttatcgtatccgccccccacatagtaaggttctgtgccaaaataattggccagcgcctgcgcagcctgcccacgagtgagtcccgtcatctcgacctcaacgccaaagcactgatccttcattccgatcatgcggcggcccccgctttcaattcctcgtccactgtctggatacgcttggcaatcgcctcaattacattgacggtgacactgttgcccgcctgcttataggcctgagcgtcagactggatggcgaggatgcggtcaatttgccattcctcaaagccctgaagccgcaggcactcacggggcatgagacggcggatgcgtccgccgttttccacgatcccctggatacagctggtttccagcgtatgggcaatgtcacgcccaacgcgcccgcggcgggtgttgctgcctgcgtagcccaaatccaccgtatcgccgggttgagcctccttgtaccccttcttggtcgcctccttgatgagcaggacaccggagcgctcgcctttacggttggacagtgtggtctgtccataccgggcggtgagacagcgggcagcgtccgtttgctttggatgcccgctgcaaaggtctaccagcacagcgttttgtgtttggttccggttgattcctctgaaatcgctggcgttcagcggaattgctgtatcccgctttccgacgatcccatctttccggttaaagcccaccagatataatccggtcttcccgcccatgccaccagcgccggcagtctgggtgcaggctactccgtctgcgtcatagatccgggagccttgcggccctccgaggacttgtacaagagcttttccacctgtgccgaagacaggtaatattttcccggcgcatcggggatcaagatatccgataaggaacagccttcgtcttgattgcgggactccgaaacatttgcttaatgtatagttgaaaataatgtatagtcacctcctaaaactgatgaaaaatcagaaaaaatcatcgtcacacttaacataattccgtataatttaaacaatggcattgccatatcaactaataggaggaatatgctaatgacgatagagcacacaggctcattgagcgaatggctcaggaaaacgatcagcaagttaaagtcacacttagctgaactcggctacagtgaaagcacgattttaaggttagacgcgacatggaaggagttgattgtatactgcgaagcgcatcagacaactgagttcaccgtggatttagagcggagatttgtctgggaacggtatggtgccgatcttggcgatagggatatatctcagaatgtcagccgggctattcatatgttggacgattatttacagtatgggatggtctttaagcaatcaagtatcaccttgaagggcttttctccagcctataaggagctatttgaaggctttttggacagtttgcgccaaaaccaagtggctgaaggttctatcagaacttggcggagcaggctatttcgctttgagtattttctgctggagtccggcattgagcatttccacctgcttgagctgcaccatgtaaatacttatattgaatctttgactggattttctcccggtacggttgcggcaacaattcgcatcttaggcaagctgtttgattacgcattggccaaaggctaccattatatcagttacgccaatgctttgccctgtatcagacggacgcataagtatcgcctgcctactgttttttcaccggatgaggtagagtgcattctgactcaggtagaccgatccaatccgttggggaagcggaactatgcgatcctgttgttggttacccggctggggctgcgcatcagtgacgtgcgattgcttcgattcgagaatattgactggaaaaacaagcgaatttcaattcatcaacaaaaaaccgggatacccttagaacttccattgctcgaagatgtgggctgggcaatcattgattacctccagcatggccgcccagagacagactgtccatgtatatttgtccggcaccttgcaccgtttgatgtcatgagcggttctatgcaaaggttggtttccaaactcgtttctaaagcaggtattcatgtctctacggataaaccgattgggatgcacagcttccgacacagtgtcgctacctccatgctgaataatggagcagaattaactgacattgcgcaaacgctgggtcatgccacaccggaaagcacacaggtatacgttagcctcaatacagaaatgctgagacgatgtgcattggaggtgcttctatgagtaagaagcccttctttacaggaccatttgctccaatatgcgaatcctatgtggcacaaaaaagggcatctggtctggactataaccagcaggccaaactgctgcggctatttgataatttttgtaaagattatgagattcagagttacacaattacgaaagagattgcattgacatggtgcaagaagcgcccaaatgaggcggacgccacccgatatagccgagtgagtgaaatgcagaggtttgcccaatacctgtgcaaacaaggttatccatcctacctgcttccagcccttcccaaatgcggagaacaacacgtaccctatattttttcaacggatgagttacatctcatttttgaacgacttgactcactttctccgactaacctatcccctaaccgacatcttactatgccactcttatttcgcgtactctatggctgtggccttcgaatttctgaagcgttggcgttactaaaaaacgatgtggatttgaaagacggaattttgcacatacggcacggaaagaatgaccgcgagaggattgtcccaatgtctgccacattgacggaagaatgtagaaaatatgcgcaggctgttcataaaaacactgtcgaatcaacgccgttcttttatgcaaagggcgggaccccttatacaaaatccaccattggaaagttctttcgcggcattttgtgggatgtggggattccatataaagggaagcaatttgggccgcgcgtgcatgatctccgtcatacattttgctgccataatatccaaaaatgggctgaagctggactcccaatatacagcaatctactgattctttcccgttatgttgggcatacatcgattagttccacccagtactatctccgcctgaccgcacaatccttcccccatatcatggatatttgtgaacagaatttgggcggcatgtatgctccgtttgaccttgccatggaaagagagggattgcaggatggctaatcgtggaccgactttttttgccaaagcgttatcaagatatttctttgagtatttaccatctgaaaggggactaagccaagaaacaattcaatcctatcgagacgcaatgtccttgctactggatttctgtgaacgggaacgcaaaattcgaagagataggctggaagttagcgatttcaatagagagctaattgatgctttttttcggtggctggaacaggagaaaggtaactctattacgacaaggaaccaacggcgagcagcaatcaatgcgttttttaagttcctgcagtatgaagatccaggctttgtactgctatgccaacagatccgggaaattcctccgaagaaatgtgagcaaagggttgtcccgcatctttcggaagaagccatccaaactatttttggacagccgaaccttacaacgcgtgagggacggcgtgactttgccttcttgaccttaatctatgaatctgctgctcgtgcatctgaaatcgctaaccttcgctttggtgatatccgttttgataaaaaatgggccgttgtacatctgaaaggtaagggaagaaagttccgagatataccagttcttcctgtacctgcaaagatcttgaaggattatctggctgaggaatcccaatatcgccaatgtgatatagatgccccgcttttttgcaacagaagcaaggcccctctaacacgaggcggtgtctactacatcatacagaaatatgtttcccttgcacaaaaggagaagcctgatttgttcccagtgcgggtccatcctcatgtattcagacacagccgagcgatgcattggttagaggccggtgtggatttgcaatatataaaagacctgttagggcattctgacattaaaactaccgaggtgtatgcccggctgaacattaaaatgaagcaaaagctgttggagcaagtgcatccgcagcagcttagtgaccagcagccctcttggacagatgacgaaaatttgatgcaatggttgactcagctctatattccaactaaataatttcacagaataatgtaaagccagcaggagcattcttgctggctttactacacttcaggaggtgactttacattattttctgctatacattagctcaattatgttcagctgaacataattgagcgttaagcacagtccattcgacatggtaccccaggtcatccagtgcggagaggatgaccgaaaaggttttccctttgtcatgcgataaaaggccgggaacattttcaagcagcagatacggaggtcgctttgcttgagccaatcgggcaatctcaaagaagagagttcctctggcgtcggcaaagccccgtctgcggccagcgttagaaaatgcctggcaggggaatcctccacagagcaggtcgaagtccggcaggtctgcgggatcgagtttggttgcatcgggatagtatcgttcctcctttcccggttcgtagattgcttgataactggcattggcgtgcttgtcgatctcacagtgtccaacacaccggaatccgcccgcgcgggtcaatccggagcggaagccgccaatgccggcaaacatatcaaagtatcggatcagtctgtatcatctccttcctgcagcgacgcaagaaagccgagaatatcctcgtcgatgctcccggcctgcggcgctgcttgtgcgatttggatctggctgccctgcaattcctgacggatcacctgacgcacagcctccagcagttcccgctgatttttgtgttcacagatcatccggcagacggcaccggtgcgttcacccgccggaatatccatcagcgtccgccacgcctgccgctggatgggcgaggccatggagaaggacaggttcagccgcttcttgtcactgctcatgctttttcgacattcgctctgtcagacgctcatatcccttggcatttaagcaaacgtcatccagtatgatgggacggcatagtccgtccgcagcggaagcatgatgcttcagcagcgtcgcaccgccgccaagaaaaacagcaggcatggctcggacgtccaggccgctctccgcgatggcagagagcaggcgtttggtgtagcgttccgcttcctgataaatgatttttttcgcgtcctcgttcacatggctggcatcgccgcgcagaacgctttcaatctgcgcggccgtcatagacagaccaaggccacggcggatctgctcgctgatctcatccaggcagcggatcatgccgagctccagactgcggcaggtggcggcgttggggatacggttgtccagccgcatgagatccaccgtccagccgccgatgtccgcaatgatgacggatggctcatccagcatgctaccctgcgtcagcactgcggcatagccctgcggatacagcgacactttggagatcgtgatgacatagtcctgtccttcataacggaaagacaccggtttgccgccccggcacaggtagtcccggaacgctttcttatccctgccaaagctggtgagcggcagtccggctgccagatggatgtccgctgccgttccggcattgcggtatgccagttcctttgctatggcggccagcgtgagaaggtagtaatcctccgtttgggtcttgtccttttggagcggctggcgtccgctgcccaccacataatatttaccgccgtattccagcacattgttcagcgtgtacggctcatgctcatgggccaccagcccggtgtgaaaggaaaaatacgcggttttcatggcagcgtagccatgatctacaccgatgatgatgatgggttcgctcatctggcctcacctccatgactgcggtgtttctttttgggcgcttgccgctggtcatacgcctttccggcacggatgagatcccgcatttccttttgctgcacattccagcgtgtcttgccatcccagcccggatgcgccgtgcagagccgtggcaggtactgtttcagctccggtccctctctgggaaattcaataccgcctttgtagacgatatcctgttccagttctgccagcaacgtttcataccttgcccaatccgtctggtcataggcgcttttgcctgtgagctgctcataggcataatctcccacataactgagcgtctcaaagcagcagtcctcgtaggggatgacctccgcaagagagtccgggtccgccagcgcggacagataggtatcccttccctgggcaatgagccaggcgcggaagtcgataaatccgtcatcgctgcagccgtattccttcatgaccccggcggcatcccacagtccaaacttgtccgcaagatcctcataggcgtggaggatgtcgtgaaagttctgtgcctgctccggccccatggataccagccggtctttcaggaagtccatcatagcgtccatatcctgtccgcaggtctcctttgcactctggatcagcttccagaaggtatctttgttgatctcggtgatgttatcgttcatatcctacctctttcgcttctttttcctttgttttcaggagatgtgccaaccccatgcgccccagcgcgtccgcgcagattgcttcacgaaacgcgcggtattccggcgtggtggtgtccaccttgccgagaacggcccgttcataggtggttccggggacgatctcccatgtgactgcatcgaaatgagctgcttccagatagcgcagaagggtatgtccgtccgctgcctcaaacgcgccccggttatcttcataagggaaagcgtcatagggctggaagccggtgctccgctgcgcggcgcggtacagccgaaagccatcctcatccagctgcgccgcgaatttacggtagatatccgtcgctgacaattcacgccgccccatccgaggtctcctttctcacccaagaagcgaagtgttccagaaaacgaacacgcttgcgcacctttccggcagacacatccagtccgttcatctgcgcctggatgcggtgccgaatggctttcagcttctgcggatcgttgcagcagtccacgatgacatactcaccgccactggcggccagtacctcacgcttgccggtctcatcccgaatggtggacataaggcgctggcccagccgtttccgataggcatcctgcaaggcgtccatatcgccgcagacgccgtgccgcttcaaaatggcggcgatctcctgagaattgatccgggtctccgcggacagcctgtccaggatctcccgctgggcgtcaggagggagggtgggcggcgaaggacttttcttctggctcatcgcgtcggcacctcctttttggcattttcgtaacagtcggcggctctgttgcccgcgccaactcctttccatgctcattcagatatctctgcatttcacggacactttggcacccaaactccggttcctgaaaaccgccacgctccgtatacagcgtccatttctgcttttcataagggcaatcctgagacaccacaaagtaccgtccgcagcggtctccctccaacggctcaaagcgcacgtcatcatagagggggccgtccagagggcagttgtttttaaaccagacatagtaattgtccagaatggcaggctccgtgatccccatgaccaccctgccgatcctctgcagtctgccggcaagagccgtatcgctgcaaaaccagtcataccacccggcgcggatctgcgtctcacgggatctatcctgaaacgccccaccgcggaacaggtcctgccactggcgagcagaaagcatctcgctcatgacgccacctcacagggaatatcctccgcggggccggtgtttcgccagtctgcaggcaggatcttctgctcgatgatatcggcaatggcggcgaacacctgggcgatctcacgggattccttgacggtgtcctggagttcctccggcgtcatgcgggtaccttccgtccagcagcggacattttcttccgtggcggtcagaagagaagccttttcgtatgccttgcagaaagtgtttgcaactttgcccctgcggtcgatctccgcattttgctgtttgagatccttcttcgccttttcatattccagcagctccgcggcagcctgttcccgctgatcctccggtacctcctgaagctggcgggtcaggtcataccccttgttgatggacagtttctttttgtccagtgcctccttgatggagtccggggcgttctcatcgatctgcatgaccttgcccatcgtgcgctcgcccaagccgaccgcctctgccagttcctttctggtatcgacagcggaaaccgcttccggcaatgttgccgaaagcggtttttcagagaacttgtcaccaccggcagcagactgatttgctctggccttggcttcaatctctggttttagcttcagggcgatcttgcccagctcccacttttcaaggttgcggcgtcccttctgggtatccaacgcccactgcttggcctccaacagatcctcaaacgagaaaacggccattgtgtacggcagatcatgcttttcgcacagtgcctgacggttgtgcccgtcgatgatgaccatgtcctcattgacgatgatgggtgcgtagcagccgtttttgatgagatctgcttccagagcgccgagctgctccgcgctcaaaggcgggagcagctcggccatctccggcaggatcacagggctgcgttcagcgctggtatatgtgatcccggtatttttcatcaggcagcgacctcgcggacaggctcatcttccaattcctgcgccgtttcctccaccttgcggggagagaggaactccacctcgctggctttgatgaggaaaccgggctgacgctccggctcgtcctcaaaggtaatggtctcaaaatcgccggaggccgccagcttgcagcccttccaggcgaattcggcgcaacgctcggccagcgggccgcgcaccttaatggagataaagtcggtgagcttgttgccgtccttatccttatagcggcgatccgaggcgattcgcaggatggcgtagggcttgccggtggtctcgttcattttcagttccacatcgttggtcaggttaccaatggcagtgatcttcagcattgttcagttctcctttttatattatgatgtttgaaaagccgcccccccggcatcgggagggcggcagagtgtttacttgctccagctttcgctgtcaccgaggatggcggtatgggcgttggcggcctccatgactgcgtagtacgcccaatgcttgcggttgacatccgggaaggtgttcatcttgcggagattatccacaatgtagtcctcatccgcttcgcgacccagcaggcggttgacgatggtcacaacctccgcacggttgatctcgtcgtcagcgcgaaaggagccgtcaccatagccgttgatccagccatgcttggcggcagccttgatgtacgcggcggcccaataaccgtcgctcacatcgttaaagtccttatactgttccatgatctcagcatcgccatcgccgtacacatcaaagaaacggacggccagcgttgtgaactcggcacgggtaatggcatcgttgggggcaaagatagtcttgctcttaccgtaggtgacaccgttgttattgaggtatttggcataaccggagtaccaggcatgggcgggaatatccgtaaatctggtgttggccacggtggaaatggtatcgccgttcttctccgccagcagacgggcgaagatagcggcggcctccgcgcgggtcatgctgcggctggggccgaaggtcccgtctgtgtagcccaggatataggtgccgtgacgctctctttcctcgatttccggaacggtcagctttccgtcctgatccgtcttgcccttggccgtttggctcaggtcgcccttaacaatgatgtttttattctcctgcggatttttcttgtggtcggtgacggtaaccgtcacacggtggtttttatccagatccgtgccatccggcagtttgaccgtaatattgccggtcttgccgatggcgacctccgcgttggggatggggcgtccggtatcggtgtgctccaccttgatggtcagcgtccagcggtcgccgtccgcatcctcatagccagcagtgaccttgccgtcctcattggtcttgccgctgccggtgggaacggtgatctggcccgcggcgtcggtcttactggaggcgtagttatcattcttgtctgtaacggcaatgctcatgcccggtacagcgctcttgtccttgacgagctgcacggtgacggtggtctgatctacgtagtccagcaggcggctattcggcaggcggatagagatcgaattatccttgtggagcgcgacagcggcgtttgctacgggattcttggtgtcggtatcggtgacggtcacaaggtagccgcccacaatggcctcacccttactgtctgtggtggcgctattgtagatcttttcgatgggctgtgtctccagcttttcgccacacacggtacactccttgtgcttgctgccctcggaatcggtggtaggctgcttgtcaacgatccagtcgctgggcttatgaccggcaggctcggtgtagttgctcttgttggtatcgccgcagcgagcacaggtgttagtggtataacccatctccgtgcaggtgggagccgtcactgcggacttgtaatcatgtcccagagccttttccagcacagcgccgcagcgggtgcagagctggggttctgtgcaggtagcaggagcgccggggatatggccatccgcggggtcggcatccagacggtggcaaccgcagcgggtgcaccggtattccatgaccccctcgccagtgcaggtggcgttggtgacaagggtgcccttgtcccagctgtggcccagggcgtccgtatagtctgtgacaaaagaaccgccgcagccatcgcagcgatggatggtctttccctctgcatcgcaggtagcctcgatcacatgggccttgtaatcatgcggaatggtgggcgtaatttcctcgatatggcggtcgccgcaaacggagcattcccggacggtatagccggggctggtacaggtggcagccacggtatagacctcatagctgtgttcgcccttgggcgtggcggtctgcttcatctgtccacagcgggagcaaagctccagcagcttgccatcggtttcgcaggtagcgtcacggatgacgatgccctgccatgcgtggcccagagagtccacatagtcgcgcttttcgattttgccgcactccgtacagaggtagcggtcatagccgagggtggtgcagccggccttggtgctgtccagcagaatatacttgtggttttcaccacagcccttgtcggtgcagcaatttccgttgcagtgcttgtcctgacagccacagttggggttagagcagccacagccgcagttgccgttctcatctgtggtgtcatcccgcagccagacataggccacaccgttttccgtcatatccacaccgtcacaggtgtaggtaatctcgtaatagacagtgtattgaccctcgtccgtatagttgggtgcggtggtcatggtgcagctatccgcgctgttgccgtagcggatggccgtgcggacaccggcttcagacaagtccgtgacgctgatggtatggggctgtccgtctgccacgccgtagtagctggcaacaacggccttggccgccgtgtagtcatagcaggtatagtcgcacaggcggcacttctccacggcagcgaaacggccatgagcgggctggggcagagtctccaccgccatgtcatggcgctccagcacagaggatttctcgtaattcgtaccgtaacagaagcagcagtaggtgccgcctttggtgacagtgcggtggtacttgctgtctacacattcatgggtaacggtctccggcagatccagataaaatttggcggcgcagtcatgcagaacgtagatgttcttatcccatgcgtagggggcgccgttggtctcgttactgttccagtctccacagcggctgcatacggatttggtccagtggtaaccggtgtaataggcgttctcgccggggacaccggcatccagactgcctaccgttacttcgtcaatacacatcccgttggaatacttgacgttgcggttcagggccgtctcaccggagcgggtatactccggaacacgccagacggtgaaatccgtgttttcccggcaggtggcgcagtagaaggtctcgtgggtgacgatggcgttgacatccagttcattggtccggttgctggcctgctgccaatgctcgacgggatcatggtagctgttctgctgggcggctgatgccgtggggatcatgccaaggcacagggccagtgttagaagcatggccgttacacggtgggaaaagaaatattttttattcaaatgcgaacttcctccttatattttccgaataggtttctttggatctttcgtgttgattacttgattaccgcccctctcaggtgtttttcttttttgcagatactcattccagtccttgccgctgtggggttcctccacggtcacgacgtagcccatggctgcgtatttgtcctgtaattgccgagccgcctcccgtcccggcccatctgcgtccaggcacaattcgatccgtttgatctgcggatgatctgccagataggcttgcagcgcaccgccataaaggccgcagagggccagcgcgttcggtgtgttccggtggagtgtgagatagctcatcaggtcgatgggcgcctcgaatacgaaaacctgatctgagctgcggtcatacgggagtgcgaagccaacgcgtttatcgctgcccgtcacatctccgcggaagcccttgccctcccggtcataggttccgcgcaggcccgcgtattttgcctgtcccgcgctgttctttccgacgaacacgcagttgtgatgctcggcgtcctcatacagcaggccgctgttcaaaaattgacggatcacctgtggggcgatgccgcgcttgtgcaggtaggcaaacaccctgcgatcatccgtattccggggcggcagggtaaagggcttttgcacctcgtcacgcttgacaaaaggcgccgctttagcgggagagtctctggctttcccgtggaaggtcagcaggtattccaccgcttccggaaaggattttccgcaaaactgctggagaaaagtaatggagtccccgccggtattctgcgagtaccgaaaccacttgcggcggtccttgatccgcaggctgtccatttccgctgtggtgtggtatctgccgatccgccgcacctgatagcccaaatgggtcagcagttccggcagatccgtttccttggcgatctgcatttctgtgtctgtgaagcgtcttttgatctcgcttgccatagtgatgacctcctttctggtgaaacgcaaaaagccacccagggcatccgagagattcggatgccctgggtggcttttccctaaatcgtgttcttttgtttgggctttaacgcgggcctacacggcgttaccttcgtggggggtgtccgtgtccgctggagcggtcacgtcggccacacggggcgcgacaggggcctcagtgggggtgttctgctccgtggcgttctcagcgtccgcttcgtccagtgcctgcgtgatcaggttcagcacgaagtctcgctgggtgagctttttgccgctgcggagcgtctcgcgctccaagtgacgcttgatgcgctggaagagttcttcgggaatctggaatgccatcgttctgcctttttcagtcatttgaatgccgcctttctgattttccatcatgttgtaatagtcttggatgaggttgacgatgtactcgctggtggtcaggcccagccgttctcgttcttcactgacccgctcatgtaggtcgatgggaatctgagcacacaagtttttagtggttgccattctcggatacctcctcgttttttgtaacgcaagcatacccgaaaggttacgagaaagctattaccaacaccaccaaggaatggcagacaaacgaagcgaaagcaacataagcaccaatgaaacgaaaaaggccgccgttctctcccacatggggaaccgaacggcggcctgccttcttatgctttattcttttttagcctcggtgttcaagtcacaccagtccataagagcgctctgctgaatctctgaaatgtcgcctctcgcgtggaaaaaccgattttccgaaaaaagcgtttttcctaacttttccgccagaaaaaagcctgtaaagatgcaaaaacaccgcactttcgtgcggtgttttctgtgttgcatctttcatcaacacatcttggtccgagtagtgcgactcgaacgcacgacatccagctcccaaagctggcgcgctaccaactgcgctatacccggatattcgatttttctgcatgataccatgcggagaaggaaaaagcaagtttttcgtgtctgtgggcagtgctgtggtcaagcccggttttgcggggggatcttcaggcgggggatttccgccgcaggctactgtcccaaggacttccaggctttcactttttggggaatggataggctctctatcctcccaaatcacgcgtgctgccaactacgctacatttggtcatagatatttctcccgcccgggggcgttcttccccacatacgtgcggcaatatactctgcgatccgccgcgttggcactctggcaccatcttttactggatcggggacagcacgatgggttcattttatacctctctattttacctgtttctccgccaaagtcaagtctattcgcttccggccggtatgtcggaaaggccgtccggaggctatggggcctccggacggcttgaccaggtctcttcacttggaaacgcagagtcgattgttctccacggtaagcttggcggtgtcaccggccttgagggtgccgtccagcatcttctcggccacggcgtcttccaccttgctctggatggcccggcgcaggggacgggccccgtacttgggatcaaagccctccttagccagctctgccacagcctcgtcgctggcatccaggtggatgcccatggtctccatccgggcggagacggtcttcagcatccgccgggccacttcccggatgtcctcctccgtcagggggcggaatacgatgatatcgtcgatccggtttaggaactccgggcggaaggtctgacgcagctccgccatcacctgctcccgggcggtctcgaacttcttttcagcgtcaggatcggagtcccgctcctcggcggaaaagcccagcttgctgcccatggcagtgaggctgcgggcaccgatgttgctggtcatgacgatgacggtgttcttgaagtccaccgtcctgccctgagagtcggtgatccggccgtcatccagaagctgcagcaggatgttccacacatcctcgtgggccttttcgatctcgtcaaacagtaccacggagtagggcttgcgccgcaccttctccgtcagctgaccgccctcctcgtggcccacatagcccggcggggagccaatcagacgggacactgtgtgccgctccatatactcagacatatcgatccggatcatggcgttctcatcgccgaacatggcctctgccagggacttgcacagctccgtctttcccacgccggtggggcccaggaacaggaaggagccgatggggcgcttcggatccttcagacccacacggccccgacggatggcccgggccacggcctttacggcttcgtcctgacccactacccgctcgtggagggtgtcctccatgtgcagcaggcgggtgccctcatcctccgtcagacgggtgacggggataccggtccagccggccaccacggcggcaatgtcgtcagcgttcaccgggcggtgctgggtgttgttcttgcggcgcttctcccgctccatctccacctgctcctggtagtccttctcaatgtcccgcagcttggcggcggtctcatagtcctgcttctcgatagcagcctccttgtccttggccagggcggcgatcttctcctccaggctcttcagctccggggagatctcctccgtctccatccgcacccggctggcagcctcgtccatcaggtcgatggccttgtccggcaggaaccggtcgttgatataccgggcggagagcttcacggcggcctccagggcctcgtcggtgatctggaggctgtggtgcttctcgtacttctcccgcaggcccttcaggatctccagagacgcctcctggctgggctcacccacctgcaccggctggaaccggcgctccagggcggcgtccttctcgatatacttccggtactcgttcagggtggtggcgccgatcacctggatctcgccccggcctagagccggcttgatgatgttggcggcgtccacggcgccctcggcgctgccggcgcccacgatggtatggagctcgtcgatgaagaggatcacattgccggacttcctgacctcctccagcagcttcttaatccgctcctcaaactcaccccggtacttggtgcccgccaccatgccgctgaggtccagggacaaaaggcgcttgtccagcatctcgtcgggtacgtcgcccataacgatcttccgggccagaccctcagcgatggcggttttgcccacaccgggctcaccgatcaggcaggggttgttcttggtgcggcgggagagaatctggatcacccgctggatctccccgtcccggccgatgaccgggtccagcttgccggcccgagcgtcggcggtcaggtcccgggtgaactccttcagggtcttgttcttgccgttatcctcctttgcggggctggtgccggagcggccgggatcggcggcctgactccggggcatctcacccagcttctgcatcagggctgtgtacaggtgacgggcatccacgccagcggtgcgcaggatacggacggccatattgttgccttcccgcaggatgcccgccagcaggtgctccgtgcccacgtagttgtagccgccccgcatggagtcctccatggccagctccaccacccgcttggcgcggggggtgaggccctgggcgggattgctgccgggcagaccggcacccacgctcttcttgatgatctccacgatcatgtcatcggtgaggcccgcctccgtcagaacggtgtgggccacgccctcctcttcccggatcaggcccagcagcaggtgctccgtgcccacgtagccgtggcccagctcaccggctgcctcctgggaaagccgcagggcctcctccgccctgggcgaaaatttgttctcattcatagtgtcttaccttcctttccatgggaaagtcccgtttacttgttttccttctgctccttgtgagcggcctccagagacctgatctggtcccgcagctccgccgcccgctcaaagttctcctggtgcacagccttcttcatctccagcttcagcgcgttcatctggcgcagataggcaaagcggctctggtcctcctggcctaccaggtcgtccttcttttcctgctttgcctcctgctgctggacaggagaggcgctcagggccggcatctcggcgaagaagtcgtcaaaggggtcctccagcatcttcattctccgccccagcaggctgggcatgggagagaagaaatcgtcgaagaaatcgtttccaaagaggctgttcccgaagaagctttgcatcatccgctggctctgggcacccagccgctgggtatagcccagcttttccgcgcagtcgctgcacaggtgcttctcttccacatggccgttcacgttgctccgatacacaaaggtaacttcattcttaccacaattttcgcatttcataaatcaattcctcctatcatctggaaactgtgcgtgcttattgaaacatttttccccgctgcccgggtcccggctacacctgcaggatcagcacctgcttcatgatgtccgcccggacggtgtcccggctctcccgcgggaccgcggccagggccttgtcgccgacggcggccagaatgctccgacctgcgttctcctccagggcgccggcctggaccagattgttcaggatggcccgagcggaggccaggtccacctggctgcccagggtgttgatgacctgcatcagcagcgtctggcggtctacccggacccgggtgatccggatgtagccattgccgccccggcggctctccacgatataaccccgctccggggaaaagcgggtggacatcacgtagttgatctggctgggtacgcaattgaagcgctgggccaggtcattgcgctggacctccagcacaccaccgtccgtctcctccaaactctcctgcaggaagctggcaatcaaatcggaaatccccacggatgattcctccctttccaaagaacgccttgtctctttgactttgactttctttaaccttttgttctgtgtttagtataacacgcccgagcaaaatgtcaagagctgaattttgactttctttgacctatttgaaaacaatttatgaacagttagtcttgacaaacgtcatttttggacgctttcccgtattttttcgaaaatttaaccatagaatttgaacggctggtacttgctttttttaatttgtatgctacaataggggtacaattctgatggaggtgcttcccatggcttacaaaatcacttctgcctgcgtgagctgtggctcctgcgcggacgcttgccccgccggtgctatcagccagggtgatgaccagtacgtcatcgatgctgccgcttgcctggactgcggttcctgcagcgacacctgccccaacggcgccatcgtccccgaggagtaatcgaggatacataaaaggtccgcgagccaaagctcgcggacctttttgtcgtttcggcaactgtaagaaatctgtaagagatttctccatagagttgtaagaaattggtgttatcctgccggtgttccccgctggagtgaagaaagaggccctttactcccgtaatattggggacagccgatttgaaaggagacacacgatgaaacacgcttggaagaagctgctggcagcagcggtgctgccctgtctgctggcgggatgcggtgccctgggagggccggaatctgaggtcccctccatggaccacttgcttggcttgacccaggaacagcggctggaggactacgactacctggtccagacactgggggacagctatctctgcatgggtgtccgagaccgggacaacccggaggacccgtcggcggccatcttccaggcataccgggagatgatccaggaaagcgacagcgacgaggtattctattccgctgtttacagcacactgttccgcctggggacgtacggccacctctggatcgtggagccggatatgtaccgcgcctactgtgaggcctatgaggacggcggcatccaggaccgggagcactggcgggaggtgctgacggacccggtgaccgtccggggctatgaaagactccagacgctgctggatgcctacggcgaagaggacggcacggtcaattcagccgattcggaggagcctgccgcgaacctccacaccctgctcctgcccggcggagacgtggggtatgtgaagatcgacagcttcccggcggaatatgaggacagctacgccacagaccgggcggccctgacggacttctaccgccaggcggcggactgcacggatctcatcatcgacctgacggacaactccggcggaagcgaggtctactggcagcagctgctggcggcgcccctgacggaccgtcccctctcctgcaccaactatgccctgctggcggagagcggcaacaaccgcccctatatccaggaggtgttctccccggaggagctgcaccccatcgcggacctgccggatctgcccaagctggagcgggacggaatccaggccgccacccactttgtggagagcaccctctctgtggagccagcggcagagcgggcccccttccacggccgcatctgggtgctggtggggccagcggtctactccgccagcgagtccttcgccgtgttctgccaggagacaggcttcgccaccctggtgggcagtcccaccggcggcgacggcatcggggctctggatccagtcttcctgcagctgcccaacagcggcatcctggtgcagttcaccatgatgttcggcctgaacggtgacggctccagcagtgaggaaacgggcaccacgccggacattctctcccctgccggggaaccggctctggtgacggccctgcgggccatggagggagtcgcatgaccgaccactgtctggaggaaagccgcggcctttccggaggaacgccacaggggctgcccgcctgccctcccccgtccgctgaatgcctggagcggtcccggggcgggctctccctcaatcatctgaaggccgtggcggtggcggccatggtgatcgaccatatcgccttcgcctttgtccccgacggcaccctgttggcgattctcctgcattccatcggaaaaatcaccggccccaccatgttctttgccgccgtggagggctgtcaccacaccagaaacctcaaccggtatctgctccgcctggctgttttcgcgctggtcagctggtttccctttctgtacttccacttcggcggcgatctggccgccatccagctgatgcgccccaatgtcatctataccatttttctgggcgttctggcggtccgcatccgcaggagcccgcgcctctgctctgcctggaaggtcctgctgattttgctcctgttcatcctgtctgtcccggcggactggggctacacaggcgtggtgattatcctggtgttcgactattattatggcagttggaagcaccaggcgtttgcctactgcatggtggtcatgctggacatgggggtgctctccctgctgatccacccgtttttcggactgttttacgaccatgtcttccagatcgactgggagctctacgcctactccgtcgagtacgtgggggcgtttctgccgctgctgctcctctcccgctacacaggccggcacggaaccagcggcggtttttccaagtggttcttttatatgttctaccccctccacctgctggtcctgggctggctccgggccgtgctgtaagtctcggccctcacgacccgcaggggcctggaccggcgggcgatgagagcatcggcctgctgcagaaacttccatcacccaccgggccagcggcagcaaaaagagaaggagagaacatgcagtggccgctccgcgccgtccgcacgatccgccacggggcagcaactacaggaatcgcaaaaggcccaaaggccagaccaaatcggcgcttgcaccgatcgtcgcgcggagggccactgcaccggagcgcgcccaagcggccttttcttttgaaccgtgccccccattgcaagaatgatgatcttccattataatatgaatatagacatcatccaatggggggatcgacttgcagcactgggaactcctctgccccggcggactctccttcgtctgcgatgacggcctgttccagcccagtaccgactcctttctgctgggcagctttccccggctgaagccggggcttcgggtgtgcgacctgggcagcggcaccggactgctgggccttctgctgttccagcgccagcgggcactgtccgtcaccggtgtggagctgctgctggacgccgtccgcttggcggagcaggccgccgcccggaacggcctggcagaccgcctgatcttccgccggggagacctacgaaagatccgcggcctgctgcccgccggtggctttgacttggtggtgtgcaacccccctactatcccgccgggtccggcaggctgccggagactgaggccctccgggctgcccggtccgagactggctgcaccctggaggatatctgcaccgcagcagcctggctgctgcggtggggcgggagcttctgcctggtccacaagccggagcggctggcggacctgtgctgcgccctccgggcccggggactggagcccaagcggctgcgcctcgtctgccgccgggcgggggacgccccttccctgctgctgttggaggcccgccggggcggacggcccgggctggacatcgccgcccccctctgcctggaggacgggaccggccgccccacggcggagctggacaacgcctatttccgaacaaaggagacgaacgcatgagcggtacgctgtatctggtggccacgcccatcggcaacctgggggacttctctccccgggcagcggagacgctgggagccgtggacttcatcgccgcggaggacacccgggtctctgtgaagctgttgaatcactttcagatcaaaaagcccctggtgagctaccacgaacacaaccatgccgctgcgggccaggccatcctgcagcggctgctggctggggagtcctgcgctctggtgacggacgccggtacaccggccatctccgatcccggagaggatctggtgcggctatgtgccgaaaatggggtggaggtgctctccatccccggctgctgcgcggcagtgaatgccctggcggtcagcggcctgcccacggggcggttcacctttgagggcttcatcaccgtcaacaagaaaagccgccgggaacggctggactctctgaaaaacgaggagcggaccatgatcttccacgaggcgccccacaagctgcgcgccacgctggaggacctgcgggagaccttcggcccggaccggcgggtggccctgtgccgggagctgacgaagctccacgaggagactgtgcgcaccaccctgggagaagcggcggcctattaccaggaaaacacccccaagggagaatacgtgctggtggtggcgggcagcccgccccgggagaccgccgccgtcacgctggaggaggggacagagcaagtcctgcggctggtggcccagggaatccggctgaaagatgccgcccgggaggtatcggcccacacgggtctttccaaaaacgagctgtacgccgcggccctggagcggtcatgacccgcgcaggacatgcagcgcagaagacgcccatgcggagaactccgcatgggcgtcatgttttcagcgcacagggcgctcacagctctttcaattctttcaggcacttggggcagatattcttccccttgaataccgtgatgtctttggtggcgtcgcagaaaacgcagctgggcttgtattttttcagaatgacggacgagccttccacatagatttccaatgcatccttctcgccgatatccagcgtccggcgcatctcgatagggagcacgatccgtcccagttcatccacctttctgacaattcccgttgatttcacgatgtatctcctttttcagcaatatgtcctaactatccatttataagaacatatcacagacggtcgcattttgtcaatttgattccaaaaataaagtgaatttaccaatttgcttttttgaaatctcagttgtcctctctatatttttgtgaggcaactgggtatccgtcacaaacacagggggaatgacaatggcaatgacctggatctggaccgggatggtggtgctgtccctggtcttcggcctgttcaccgggaatctggacgccgtggccgacgcagctatggacggcgccgcctccgccgtggagctcagtgtctccatggccggcattctgtgcctgtggagcggcgtcatggaaatcatgaatgtctgcggcctctctgccggattggcccgggccttccggcccattctgcggcgactgatgccccaggccagccgggatgaaaaaacgttggcggcactctccgccaacgtgtccgccaatctgctgggactgggcaacgccgccacgcccctcgggatccaggcggcccgacggatggcccgcggctgcagcggcaccgccagcgacgaactgtgcctgctggtggtgctgaataccgcttccatccagctgctgcccgccaccatcgcctccgtccgcagcgccagtggagcccagtctcccttcgacatcctgccggcggtgtggctggcctcggccctgtcggtggtggttggcgttctgacggccaaattcctggccgccgtggggaggtgccggcgttgaatctcagttctctggtgatccccgtactgctggccggggtggccctctacggcatggggaagcgggtggatgtctacggcgccctgacccacggggccgaagaggggctcacggtcctgctgaaggtcctgcctgccctggtgggactgctgaccgccgtggccatgttccgggcttccggcgccctggagtggctcacgggcctctgcgccccggcgctggagtttctgggcattccgccggagaccacgccgctgatgctggtgcgccccgtatccggcagcggcgccctggcagtcggctcggacctcatcgccacctacggccccgacagctacatcggccgggtggccgccgtgatgctgggcagcacggaaaccacattctacaccatcgccgtgtacttcggctctgccgggatcatccgcacccggcacacggtcccggcagccctggccgcggacctgacggggtttctggcctccgccttcgcggtgcggctgttcttcggcgcctgatggggcggcgtcccgcgccgtcaagctgcgctgagataaggctccagcacagcggcgccgccgtaggcggaggcgaactcaccgtccaccagataccgcacctcttccactgcccgcagggacagcagggagtccgccagtgcccggagggccagggacagatccgcctcctccggcagacccggcagagccgccgtgggcaggtctacatagcacgtgctctcttccagccggacggaagtcacctggaatccctccggaatggcggagagccagtccttttcctccgtcccctccagcagggccttgaccacggccccggcctgcgtgtccccctcgtacaggtccagtgtcatctccaccggcgtcaggccgccggtctcatccagaaagtacagggtggcgttcagcgtgtcgatcacatcctcgttgctggaaaacaggacatccctggctgtgaagatctgccggtcccggtaggccagcggctggccccggaccgtcacgctgacagcggagatctccggcagctgggtcagcgtcagggtgatggcatagtctgccaaggccagcgccacgccggagagcagccggtagcgggaggagaggtccaccttggcccgggtaccatccagctccagggacagcagggtagtctcctctggaatggcgctggtgagggcggcgtcctccggtcccgccagcagctccgtcaccagatactccgccagctcccgggtgtcccgcacctcgcccgactcgatgtacagcggctccgcccgcagggcatcgccgccaggggcgtcggacagatccgcctccaggaaatagaggtcgtatgtctcgccctcgccggaaatgcggggctgtccccagccgaaggccgccagaagggcggcgcacagcagcacggcaatccatcgctttttcatgtctggccgcctccttcccgccagggccagcggacggtgaaaactgcgccgcctccaggacggttggccgcctccacagtgccgccccgcttttccaccgtgtccctgacgatggccaatcccagacccgtgccgccggcagcgcgggaccgtgccttgtccacccgatagaaccgctcaaagatccggggcaggtcctcttccgggatgccggcgccgttgtcctccaccgtcagcaccacctgatccccctcccgaaacagggagacctggaccgtgctgcccggcggcgtgtacttcacggcgttgtccgtcagattatagatgatctggtggatctcatcccgggtggccagcatcgtacaggtcccctccgcccgataggtcagttccgttcccttctcctgggccaccaggctcatcatccgcatcacctgctccagcaccggcagcgcgtccactaccaccggccgctccagcacgttgctgtccagccgggtcaggcggagcagatcctctgtgatacgggagaggcgctccgcctcctgcccgatgtctgtgacaaattcccgggccgtctcccggtcgatgttctccgtctggaggatggagtccgtcagcagccggatggccgccaggggcgttttcagctcgtgggaggcgtcggacacaaagcggcggcgggcgttctccgtagtctggaggcggtccgtcaagctgttgaactcctgggccagctgggcgatctcgtcgcgtccgggcacctccgcccggtggctgtaagcgccctcccgcacctcccggatggcggtgagcagctggccgatcttccgggtcagcgcccgggacagcaggccgctgagacacagcaccaccaccgcgatgccggcggagagccgcaatagattgccctgcagcccctccagcagagcggcctgctccgtgtcatactcgtatgcgtatacggcgccgatgatctggttctggtacagcaccggcgaggccgcccggctgcggaaggccccgtcccggtagctgctggagaacacgtcgttccccagcagggcctggacgatctctgtgtagaagctgtactcccccagggcgtcgttggtctcccgggtatcgtagaggaccttgcccgcactgtccgtcaccaggatgcggctgaggcccgtctcctccaccaccgccatggcctgggacacattctcctcggtcagccggtccaggccggacagggagtagaccatcacggacacgctgctctggagcgtggttgccttggagcggaacaccagatcctgcgatacccgcagcggataggtgttcagcagcagcagcacgcccgcgataatcaggatatagctcaggccgaacttgaactgcaggctgtcccagatcctgcccttatcctttgaaatagtatccaactccccacttggtcataatatactccggctccgccgggttcttctccagcttctcccgcaggcggcggatgtggacatccaccgtccggtagtccccggcgtaggcatagccccacaccacgttcatcagattctcccggctgtacacccgccggggattgcgcatcagcagctcgatcagatcgtactccttggcggtcagatccacggtctttccatcccggatggccacccgctcctccgtgttcagggacaagtcccccgcggtcaggacggcgccccggttccgctgcgtgccggcggcccgccgcagcagcgcccgaacccgggccttcagctccagaatgttgaagggttttgtaacatagtcatccgctccgcactcaaagcccatcagcttgtccgcgtcctcgctcttggcggtgagcatgatgatgggcacattggagaactcccggatccgcatacatgcctcctgcccgtccagctccggcatcatcacatccagaatgatgagatcgaagcggccgttgcgggccagctccacggcggaggcaccgtcataggcacactccacctcgtacccctcgttctccagattgaatttcacgcctttgaccagcagcttttcgtcatcaaccaccagaatcctcatttgtcacctctcctttgccgttgtccacagtgacgcggtcctccagctcggcgaatttcgcctctccgatcccgctcacctccatgatctcctcaatgctcccgaaggggccgttggcctcccggtacgcgatgatccggcgggccaggctctccccgatgccgggcagcgtgtccagctcctccgccgtggcggtgttcagatccaccggcgggaagtccggggcgatctcctcccgggggacctccgcctctgtctcgatgactacgcccgggacgcgatcctgccgatcccgaagagacaggcccgccagggcgcacaggaacaccgccgtcaaccccagcagaatgatctcactttttgtcggccttccccgtccactcactgttgaactcccacccgttttttgatatactatgaattgaaatgtcgaaccgcggcgcttttcgccgccgctgccgcgcgatgcaagttgattataccacagatggtaggagtttgatatgaaaacacaccgctttttctctgtttttttgctgctgatcctggcggtctccctgctgacaggtcctgcctccgccgcagaggtgcctgaccccgccatccaggccaaggctgccctgctggtggacgccaacaccggccgcatggtctatggaaagaacgagcacgaggagctctatcccgccagtctcaccaagatcatgaccgctctgctgacgctggaggcagtggacagcgggcagctgtccatggaccagccaatcactgttacggagagcgccctggaggggctggcggcggatggcagcaccgccggcatccgggccggggaggtgctgacggtggagcagctgctggagtgtatgctgatcgtctccgccaacgaggcgtgcaacattctggcggagcaggtcagcggcagcgtggacgccttcgtgggcgccatgaatgaaaaggctgcggctctggggtgtgagaacacccacttcgtcaacaccaccggcctgcatgacagccagcactacacctccgcctgggacttgtacctcatcacagcggaggccctgaagcatgacgacttcctgcggatctgcgatatgaagagcgccaccatccccgccaccaatctcagcgaggagcgggtgctccactccaccaactacctgatctccaactggcgggccttgggatatctggacagccgggcccacggcgtcaagaccggctccacctccgatgccggccactgcctggtatccactgccgcggagggcagcctctccttcatcagcgtggtgctgggggccgaatccgtgaccttgcccagcggcggcacccaggtccagagcttttccgagacctcccgtctcttcgactggggttttgagaacttctcctatcagacggtgctggaggaggctgagctggtgaaggaggtcagcgtggcgctgtccaaggtggaccatgtgtccgtccatccggcggcggatgtggagctgttgctgcccaagggcactgatcccgcctctctggagcggacgctggacctggagagtcctgtggacgctccggtcaccgaggggcaggtgcttggcactctctccctctctctggagggagaggtgttgaccacggtggacctgctggcctcccatgatgtggaggcctccggcctgctgctgttttggcggaacgtgcggaacttcttcagttccaccgcggtgaaggtggttggcatcgcgttgctggtgctggcggcggcgctgatcgtctggaagctgacggtaggccgccggcgctaccggtacggccgtagcgtaccccgccgccgcgggggcggctaccggggccggaggcggcattgacacaaaagggccctggggcagcatccccagggcctttttacagagagaggcacaaagcgcagctgttgagatacggaatcctcccgctctgctcttcactctttccagaaaatccggaatagaattcaggggcgcacggcgtgcgcccctgattctagatcccttattgtcacagataccgcaccagctcttccaggggcttgcggtccgtgtgcaggcgggagggatgggcgccctccgccggatagcccataggcagcagggcgatgggtgtcagccccgccagctccgggaatgcggcgtggagcttctccgggtcgaacatgcccacataggtggtgccgaggcccaggtccgcggcctggagcatcatctgggtgacggcgatggccgcgtcaatctcgccgtggttcttgccgtcgtcctcccgcttccaggcggcctccgggtcgtatgccaccagcagcatcaccggcggatggaagtgagcgccggtgcagccgtccaccttttccagcgcctccgagctctggagcacaaagatgcgctggggctggaggttatgggcagtgggggcattgcggccggcctccagcacggcggagagcttctccgcctccacggggcggtcgctgaatttccgcagagaatagcgctccgcggccagtttcgcaaaatccatggggatgcttcctttctgatgtagagatacctgattttagcacatccccgcggccgccgcaactgtttttctcacatcccctggttgggcatccagccgctgcggaggacctcgtcgcagatgtcccggcagcgggtgtcgtagaactcgatgaatttcagggaataaatgtccgagacgatgtagcggtcccggccctcctggtagatggtcatatagtcgttgcccacatcgtacagaatcccctcccaggaggtggtgctctgggtgcccaccaggaaggtggccaccacgtagttgcccacgtttttcttcagcatggccttcaaagatccccggtaggcttcctccatggagatggggtccgtgatgacctcgctgggcaggtggttccgcatgtccagggaccccatagactggccgccctgctcctccgcggcgttcaggcggtccatagggcggccggcactggtgacggtgcggccgggcgcctccggcatgggcgggtcggcgggcatgggtgtgacttcaccggaccagtccgtcattctgggcgcgacctgcgccacaggaggcgccccgtttccgccgttgtagatattctgatagtgtgccatttccaacacctctcaagtctgataatacgcgtctgtgggattatagaagcagtggtcgccgatccgggtctgccagtatcccaccttcgagggaaagaaggaccggcaggtggggccgaaggggttgtaaaaccacagggaatccgccacatccggcaggcggttgcccgcgatggcccagtcggcgatgtcatagtggatctgttcgggtctcatgttgtagatattctgggggttgtaggcgccgccctccgtctcgctggcgcagacgaactgatagggctgaaagatgatattgcggatgctgccctgcccgacccgggcatactccccgcccttggcgtggacccggttcattacaacaccggccaccgccttcatgccgtcttcaccctctccgcccgcctcgcactggatcaggcgcgccagcagctcccggtcggaataagccattggtcgatcactcctctgtcggggcctgccatacgtaccaaacgccggtccggcagaccgcctggcccggacgtttcaccctcaggatatgcacagggactgcagaaggtgtcagcggcagcctcccggtcccgtgaagggggagtctcccagcgaaaaagtcggtctcgattttttccggatggaccggcccagccggaatgtggtatactggattctcagcgaacgagtcaggcggccgcggcatggaaaatacgcctcaagatcccgcacatctgcggagggagttccagccgtgccggaaccgattcaccgcctttggcggcgagacgcggcaggacctgctgcgcgtcctgttgtctcccccgcctgcaggttctgcgggagacaggcgtgataaaagcccgaaaagaagcgactcgcgtcttctactatctggccctgcaggacagtgggatcgaaaacgtagcgcgcctgttcgcagacattctgcagatcctgagaaacgctccggacaagagcggcgaggattgactgcggctatcacaggaggaatacagttatggatttgttcgaggccatggagcaccggcatgcggtccgctcctacgaggaccggcccatcgcgccggaggcgagagaagcactgctggcgtgcatcgcccagtgcaaccgggagagcgggcttcacatccagcttgttctggatgagcccagaggattcggagggcttccggcccactacgggaagttctccggcgtaaaaaactacatcgcgctgatcggaaagaagtccccgaacctggaggaagcctgcgggtactacggggagaagatcgtactgcgggcccagcagctgggtctcaacacctgctgggtcgccatgacgtacagcaaggtcaagaccgcctttcagatcgccccgggcgagaagctctgcctggtgatcgcggtgggccacggcaccacccagggcgccggacacccggtcaagcagccggaagaggtgtccaaggcggattcccctgtgccggactggttccagcggggcgtgcgggcggcgctgctggcgcccacagccatgaaccagcagaaatttaccttcacgcttcaaggcggcagcgtggccgcgaaagccggaaccggcttttacaccaaggtggacctgggcattgccaaataccattttgaaatcggggcggggaccgcgcagttccgctgggctccctgaccgggagccggtcttccggcagcctccgggcctcccgcccctgtcaggaggattttgatgaatatcgaaaccatacaagccccgcggggcgccatcgcagtgctctccggcgggaaggtgcagatcacggacgcgggtgcggccctggacctggccatgtccgtccggtatgagaccggcgcgtccaggctggccatcgacaagcgcctggtgtgcagcgactttttcattctcagcaccggcgtggcgggagacatcctgcagaagctgatgaactaccggttcaaggccgccatttacggcgactactcccactacgccagcaagccgctgcgggactttatccgcgagtccaatcatggcaaagacttctttttcgtgtccaccatgaaggaggccgtccagcggctgacagacgcggagtgagcagccccgcggcggcgcaaaagggacggcagcgatttcgctgccgtccctttggttcttctgcgtgttcggttttccgggcgcttaggctttcgccccccgctgctccgcaatggcctgacggaacatctcctccgtctggcggatggactcctccagagagtactgtctggcgtgttcggcatagcggcgctccattgcctgccgctcctccgggtgctcgatccaccagtcgatccgctgggccagcgcgtctgtgtccccggccgggaacaggctccgctcatccagggcgaactggggcgtggcggaccggggggaatcggcgatcaccggcaccaagccgcaggcaaatgcctccatacagctcatagcctcgatctccgcgtcggaggtgtggacgtacagatccgccatgtggaggatctccagcaggcgggcaggctcatagaactccatgacgatgggattggggagcttctccgccagacggcggtattttttctccagcggaccctttcccgccaggatcacctggatctcccgggcgtggcgggacttggcgcaggcgtcgatcagctcatcctgacgcttttccccggcgtagcggcccaccatcagcacattgaagaggccctgcatccagggttccttttcccgcttgccgtagatgtactccgggctgatgccgttggagatcacgtggagccgggcggtgtagccgtgttggcggagctggttcgcaatcatattgctggggcagtggatgtgggtgaaccggttgaagaacgtatcccggaagcggttgtatacaaagtcgttgacgcgcctgctgttgcccatgtgcagggtgaaggtgatgttctccggctggcagtggaaggccgccgtgtgagggatgcccagcttttccacatgcttcaggcccatgatgcccaggggcgacggcatcatgaaatgcaccacgtccgcccaggccgccgccttttcaaacacatggcggttggggatggccagccgcatcccctggctggtgatgagatgctccaccactggaaagaacctcatctgccgcacggcgtacttgtagtccgcgggcttgccggtggcgatgacccgcacctcgttgccgtggttcttcagcgcctgggcaaaacgccgtgcgctgatggtggtgccgttgttcgcgtcgtcaaactggtcgatgaccaaaacgatcttcataaacgtctgaaccgtctttctttggtttggcggcgcttccgccgctaacggtttagtttaccatgtttttcatcgcttgtccagggaatttcgtcgcctgcgggatctctgaacggactctgaacaacaggccccgcggcagatgccgcagggcctgtctcaggcttatttctgtttggccagggcggactccagcccgcaggcgaactggtctgggcaggaggtgctcttggcaccgcagcggatgcccttcaaacggtggatcgcctcctgggcaggcatccccaccaccagggcggaaatcccctggaggttgccgctgcagccgcccaggacctccatcttctggatgatgccggcgtcatccacctccacgcgcatctcctgggagcagacgccccggggacggaacgtatacgtcatggtcgaaatctcctcttttcatgatattgcccgtttaggatatcacatcccgccgggaatggcaagaggcggcacaatttgaagaagggggggaaattctccgtcatttcagcggaacatgcggcggttcctttccgttccccaactgtcagggtccattcctgccgtttcggatttcaggcaaagcgcgatgcaagcacagccatgatagataccagcagcaggccgctgcacaaagccagtattaccaacattgcttttctgagctttctatttgccttgacggctctgtctatccggtccgaaaagatcagaaggaaaaaagcaggaatcagaaaccaccagtatatctgcatgtaatttgcctcctccccaatccgccgaatgggtcttgcccgtccgggaaacctgcattttttattttatcagatcatctgatccggatcaaggccgcctggcgaaggcggaagcgtttgcgtcatcatcagttatctcgaaaagagactgcaggcgggttaaagaatcccggcttgacaatatcgatattcgatgatatagtggtctcaaagcaataacgatattcgataataggaggcggcagcgccatggcccggggaaaatttcagaccctgaccgagcagatgttctacattctcctgtgcctgcggcaggagcggtgcggcgccgacgtgatggcctgggtcgcagaggccacgggcagccgggtggcggtgggcccggggacgctgtacaacctgctggagcagtttttgcaggctgggtacatccgggagacgaaggtggagggccggaagcggagctatgtgctcacccccactgggcgggaagccctggaggcagaggcccggcggctgcggcagctgacggcggattatgaacggctgatggaatcggaaggaggcgccccatgaagcacacaaagcgggagtggatgcccctgtacagctttttggaccggaagcgggtcacagaccatctggcagacatggccgccaggggctggatgctggaccggctggggacctggtcctggcactaccggcggacagagccgaagcagctccggttcgccgtcacctttttcgccggggccgggcggttctctcccgctccggcggcggggctggacacctttcaggactactgcgcccaagccgggtggcaccgggcggccagctccgaccaggtacaagtgttttacagcgaggatccggcggccgttcccatcgacaccgacccggcggcggagctggagaacatccgacggagcattggaaagcccatgatacgcaattacctggcgctgctgctcctctgtctgctggaagtggcgtttcaatgctaccagatttggacggatcccgtggacaccctggccagtcccactgccctactggcggccacagcctacctgcccctgctggtgctgacgctggcaagcctgctgctctaccgccgctggcagtggcgggccgaggccgccgtcgaggcggggctgcccctgccggacctgcggagtgcccggggacttggcattctggtgttgatgtggtccggactcctgattgcaggcttgtttgcctccataagccggtccaccgggatggtcatactgaccatcgggatggtattgtttttcgcactggtctattttctggccaacgccgcccggaaggctctccaacggctgcggtgcccgccctgggccaacctcctggtaatcgtaggaatctgcatcgccatgtttgcgggcgggacaacaggtctgttcgccctcatgatacgcaatgccggttccggctggttggaggaccatccgccggtggagacctacaccgcccacggcatgacttggtccgtctacgccgatcccatcccctgcgggtggaggacctgatcgatatcgactatgacggctggtccacggaggcggatgtggagtggtccccttggccgcccacggggagtaccggcaggacgcccggctgggggacggagacctgccggagctgcgctatgagatcgtcacggtgaagcttcctttcctctatggcctgtgcaagcgtgatttcatccagtgggtggagcgggacaacgatcagctgcccatggagtattgggaggagtacctcaccgtgactgccgccccctggggtgcggaggaggttttccagcggtactccggtgcagagccggtgaaccaattcctgctgtgctggccggaccggatggcagaggtcaagctgccctgggactggcgcttgacggcagaccagatggctgtcatcggagaaaagctcctgtacgcctgacaacagccgggagaggataccctctcccggctggttttctgtctgttttcttacgctctccggtccttccgctgctccagcaccaggcggtcggcgatcatggcgatgaactcgctgttggtgggcttgcccttggcattggagacggtgtagccgaaatacttctgcagcgtctccagatcgccccggtcccaggccacctcgatggcgtggcggatggcccgctccacgcgggagggcgtggtggaaaaccgcttggccacctccggatacagcaccttggtgacggcgttgatcacatccatgtcgtccacggcgatcatgatggcctcccgcaggtactgatagcccttgatgtgggcgggcacaccgatctcatggataacagaggtcaccagattcttcagctccgccgggtgttcctccaccggggcaccccggctgaacagcgcccgcatccgatccagcagggcgttctcctccacgggctttgtcaaaaagtagctggctcccagatccacagcctccgacaccacgctgtcgctgcagaaggcggagattaggataaccttggggaccttcccctcctgctcccgcagctgcttgagtacgccgaagccgtccagccccggcaggaccacatccatcagaatcaggtccggcgcttcctcacgcgccaggcgcagggcctccgtcccgtctcccacagaccccaccaccgaaaactcctctgtctcgtctatgatcttccgcacaagggtgcggaattcctcattggcatctgccagcaatacagttcttctgatgtccatgtcttcccctgtcctctttccacaattttcgtttaccaggcacaaatgcttcagagcaggccccctctccctgccggaaaaaagtgggcgctcctgtttacgacggattcatgaagcttcaaatcgcgttttctataaagtagcataaacggacacgatttgcaacaagaaactgtaaataacttccaagaatcattcgacactttctgcgccgcgcctcctaactcattgtgccgcaaggggtgcagagtctcccggcagcagtggcttcccttttggacggggccgtggtacaatggagccatctcaagagaaaggatgagacatgtgacgctgctggaggaattagaagcgtatcgcccctggaatgaccaggaggaacgggaccgggcggaactgctgcggcggctgcggagcggcgaggcgctttacacccgggacaacgctgccgggcacctgacggcctccgcctgggtggtgagcccggacctgacacaggtgctgatggcgtaccacaacctctacgactcctggtcctggctgggcggccacgcggacggggaccgggatctgctggcggtatccatgcgggaagtccgggaggagagcggactcacggcggtgcgtccggtatcgccccacatttactctctggaaatcctcactgtggacggccacgagaagcggggcgcctacgtctcctcccacctgcatctgaatgtgacctacctgctggaggcagacccggcggcccccgtgcgccggaagccggatgagaacagcgctgtggcctggttcggtctggaggaggcggtggccgcctcgtcggagccctggttccgggagcgcatttacaggaagctcaacgccaagctggcgctgttctccggggaacaggggatgtaacacctctgcagctcaggggccatgtgcgtctgcgttgcttgccgcaacggcggttcccctggtagaatgatcccggaaaggaggcaacgcaatgcttgcagagaatttgaaggccctgcggaaggccaagggcctctcccaggaggagctggccgcccgactccatgtggtgcggcagaccgtctccaaatgggaaaaaggccggtccgtgccggacgcggacctgctgatccggctggcggaggagctggacaccacctccgcggctctgctggggccggaggtcccgccagaggcggagcgcggcggaacagcggagcagctggcccgcatcgccgagcagctggcggtgaaaaaccgccgggcccggcggatctggaggatcgtggccggggtgctgatcgcctttgtgatggtcaatttattgttgattctattgaactttgcggcgttccgcagtttccaggcggaggccgaatccactgtccaagcgcaggaactcccgcgcggagagtcgtaaatctgtattgtaaaaaattccggggcggcgggaagcaaaatgcttcccgccgccgctgtctgcctgggagaccatgtcaggccacgggttcttctgagaaatctcccgctgccagcatagtttccaccaaaattccataccctttgcttggatcgttcagcaggacgtgcgtcaccgcaccggcgaattttccgtcttgcaggatcgggctgccggacataccttggacgatgccgcctgtggcggccagaagctccgggtccgtcacagagatcaccaggtcccggccgtctgctgcattctctacaacctgtaaaatttccacatcatattcctgaacggcatcaccctccacattagagaggatggtggcaggaccggcgtggacttccccggcggccgcaaccggcatgggatcgcccagccgctcggtgaattcgccggggtccagcgtgccgaagacgccgctggtggtgttggcgtacagatcacccaaatctgtggccaggtcgaaatccccccgcagctcaccggcctctccgatggcacccttcttcaccgctttcacggtggagggcagaatggatccggaggcaaagggcatcaggagcgccgtgtcggcgtccgtgatcccgtgacccagagcgccgaaggcgccgctttccgggtcgtaatacgtcatggtgccgatgccggccatgctgtcccgaatccaggccccaatgcagtaggcgcccttctcgttctgttccggggaaacagagagcgtcacgctcccgccttcccggcggacctgcaggtcggtggccgtctccccattctcctggagcagggattggaactgctctgaggaggttacggagacgccgccgcatttgacgatgatgtcgccggtctgcaggccgcagtcatccgcgggcgtgccgctctccggcgccttcaccaccatcaccccgcgggcaaagagcttgatgcccaccgtgtggcccacggggaccagcatccgggcggaggtgtcctggtccgcgccgccggccgtcacaccggcagcgcgcgccggcatggccgcgcacaacagcaatgccaagaccagcgccgctccgccccgcagcacgtgtctcgctttttgaaatggtccatacatgaaatcacccctttccgaaacgcggccggcaaatccgctgatctgccggcgagattatcatctgccgcagacggaaaaacacgccttgcaaaatgcggaagcagccccatggcaggctttgactgtgccgccgcggcggcaaaaaaacaggacccgcaggcaaatacccgcaggtcctggaaaaaatcgttcaatcccgcttattgaaaattttgaaaatatcctcgaaagggtcatcctccggctcctccggcttgggcacgtcctcttccttcaggggcatgggctccgccgcggcgctctgctggcccgcggcccccgcctggatgggcggcaccttgggcagctgctccggcaccttgtcaaagccggtggcgatgacggtgacccggatctcgtcgtccagcgtctcgtcgaaggtggcgccgaagatggtgagcgcatcgggatggaccgccgcctggaccaagctggcggcctgttccacctcctccagaccgatgtccatggagccggtgacattgatgagcacgcccttggccccctcgatggaggtctccagcagggggctggaaatggccatcttggcggcctcctcggccttgcccttgccggcggcccgacccacgcccatgtgggccatgccggcgttcttcatgatggcggtgacgtccgcgaagtccaggttgatgaagccggtatcccggatcaggtcggagatggactgcaccgcctggcgcagcacgtcgtccgcgatctcgaaggcgtttgcaaaggtgatcttctggtccgtggcgtgcttcagccgctcgttggggatgatgaccagggagtccaccttgtccttcagctccgcgatgccggcctctgcctgctgcatccgccggcggccctcaaacccgaagggcttggtgaccaccgccacggtgaggatgtccatctccttggcgatctccgccacgatgggggcgccgccagtgccggtaccgccgcccatgccagcagtgatgaacaccatatccgtgtcctccagtgccttggcgatctggttgcggctctcctccgcgctcttgcggcccacctcggggtcggatccggcgccctgaccgtgggtcagcttttcgccgatctggatcttataggtggcgctggatacgttcagcgcctgcttgtcggtattgaccgccacaaagtccacgcccttggtgccgctgcggaccatgcggttgaccacattgttgccgccgccgcccacgccgatgaccttgatattgacaacggtatcgggaccggtctccaatccaaatgccatatagtggtgcctcctactatcgtttgtgtaaaaagggaggatcgtccctttggattcacaatatcctgtatctcataacatttagtttattgtatgacactttcgccctctggtcaagagtccatcgggcttttccctcagatttttgtccggaaaaaggaggggcggcggtccgtcccccctgtctcggcaatcttctgccaaatccgccactctcagtccagcgtgaggatcggcggattcaggtccaggcggatgctgcctgtctggttactctccagcttgctgattcccgcctccaggatctgcagcatccggtcatagtccgcgttgtactccatctccacagaaaagcggccggcgtagtccatggtcagccgggacagatcgtccaggtggatggcatccacccggtccgtcaggcccgcggcgtccagcgccgccagcagcgccagcagactggtctgctgattggcgaactctgtggacagggcgatgtccgtgcccaccgagggggccagcagctcacagccgtcgatcaccgcatagtccccagcttgagacgccggcagctgctccacgatcttgcccttgggactcagcagccaggcgctgccgtcctggatcaccgccaggggtgtaccgcactccgccacatcgatcagcagagtgtccggcagctcccgccggatgcggatgtcctcaatgtcgatgtagggcagttgctccgcgatgctgcgggcggcctcgtacttgttcagcagaaagaggttgtcgcccagctggataccgctggcctcgatcacgtccttttcggtgtaccgctcagtccccgtgacctcgatggtgtccacccggaagaacagcgtcagggccatcaccacggccgcgcagatcaccagcacggacagcagcttatagaggaagccgaagtttcccctcctgcgccgccggttggaatgtctgcgtctggccatgtcgtctctcctacccgttttctgtctcttccacgcgcaccgcgtccgcccccagagcccgcaggtcccgggccaggtcttcgtagccccggtcgatgtggcagatctgggagacacgggtctccccctccgccgccagagccgccacgcacagggccgccccgccccgcagatccgtacaccgcactggcgcgctgtgaagccgctccacacccgtgaccaccgccacccggccggatacccggatgctggcccccatgcggatcagttcgtccacatggcgatagcggttttcaaagatgttctcctcaaataccgtggcgccccggctgcgcagcagtgccgccatcagcaccgcctgcgcgtccgttggaaagccggggtagggcgccgtctgcaccggccccacggcccgcagccgctcccggcacagagcccggatgcctccgctgtctgccgtgaccgtgcagcccgcctcccgcagggcggcggtgactgtggacaggtgcccctcctccgcgccccggagatagatgtccccgccggcagaggccgccgcgcagaggtaagtagccgccgcgatccgatccggcatgacccggtacgtacagccgtggaggtcctgcccgccctctatggacacggcggagctccccgccccggacacccgagccccgcaggcgttcaggaagttctgcaggtccaccacctccggctcccgggcggcgttggagatcaccgtgacgccctccgccccgcaggcggccagcatcagattctccgtggcccccacggatggcatccgcagcaccacttcccggccccgcagccggtccgcccggcagtggaggaagccgccctcctcccggatctccgcccccaggtcccgcaggcccgcaaggtggaggtcgataggccgggggcccagctcgcacccgccggggtagctcaggtccgcctgcccgcaccgggccaggatcgcccccaggaaaatggcggaggagcgcatctcccgcatgagtacatccgaaatctcacagcggcgcagggcggtggtgtccaccgccagggcatccgcctcccaatgggcgtcgcagcccagatgccgcaggatgcggatggaggcgtccacatcccgcagccgggggcagcccagcagcgccacctgcccccttgccaacagcgtggccgccagaatgggcaggacgctgttcttggccccctggatcgtgacctctccctccaggcggcggccgcctcgcaccgacaaaagctggctcatatccgttcccctccgaatccagaatggttcaacagtccatcctatggccggcggggtttcgtggttactggcagatttccagcacggtttgataaattcgctctgtggcgtcccggattcccagggcggacatggcccgctccatggaggcccggcgcgctccgtcatgaaggatgccgcaggccgcctggaacagcgcctgaccggagcagtccttctccagcagcaccgcggcaccgccggcgttttccaggaccctcgcgtttttttcctggtggttgttggtgacatagggggacggcacgatcagcgccgggacccccagtgccgtcagctcgctgatggtggaggcccccgcccggcagagcaccagatccgccgcccgcatgacggcggccatatcatagatgtactcccgcacctgcagcgccgggtggtccgccaggtccactcccttctcccgcagcagcttcagcagcactggatagccatcctttccggcgccgtggatgtggtggaaaggttccttggccgcctccagcgccaggaagtccgccatctgccggttcatgcccgaggcccccagggacccccagaaggacacaagcaggggccggccgtcttccacgcccaggcggcgcttggcctgtgccttcgtcagatggaagaagtcccgccgcaccggcgtaccggtgacgatcaccttctccgggtggcggtagtgctcccggcaggcctcaaaccccaccatgatccggtccgcgaagggctccagcatctccgtggtgaggccgggcaccatgttggactcgtgaacggccgtggggatccccgccttggcagcggccttcaccatagggaagctggcgtatccccccgttccgatgaccacgtccggccggaactgccgcagaatggcccgggcctctccgggcgcccgaaggaggttccccacagagaccaggttgtgccggatctcccgaggcttgaaggaccggtggaagctggagatgtggacggtgcggaagtcgtatcccgccttggggatcaggtccttctccagtccccgctccgctcccacgaacaaaaattctgtctccgggtccttttcgcgcatcagctgggccagcgcgatagccgggttcacgtgcccagccgtgccgccgcaggtgaagatcaccttcttcaatgatgcttccactttgctgcactccaatcgaaagatatgagataaaagtgaagggagaagagattcggtgtccggcacagccggacattttgagattccgcctttatctcttatcttttatctcttaactcctctgggtcgtactaccccgcctttgtaggcttcatctgccgggataccgacaggacgatgcccatctccgccagctggatggacagcgccgtgccgccatagctgaaaaacggcagggagatgccggtggtgggcagcaggcccgtcaccacgccgatgttcaaaaaggtctgaaggcccaccagggtcatgacgcccaccaccatcaggctgccgaaccggtcccgggcatggagggcgatccagaagccccggagaatcagcgccgcgaacagcagcatgataacggtggcgccaatcaggcccagctcctcgcagacgatggcgaagatgaaatcgttgtgctcctccggcagatagagaaacttctggcggctcttccccaggcccacgccccacagcccgccggagccgatggtgatgaggctctggcgcagctggtaaccggctccctggggatccagccaggggttgtgccacatctcgatgcgggaggcgttgtagccgatcacgcccagcaccagatacagcagcagtccggctgcacccatagccagccccacccatctccagtggatgccgcccaccagcatcatcaccgcgccggcgcccatgatgaggatggcgccggagaggtggggctcgatgcccaccagggctgccaagacaatcagcagcaccgcatagggggcgatgccgtagcggaacgtctgcatacggtcctttttcttggagatgctgtcggcaaaatagatcaccaccgccagctttgcgatctccgagggctggaactgcagcgaagtacctggaatgcccagccagcgggtggcgttgttccgggtaatggccaaggggttgcccggaacaatcaccaggatcagcagaatgacggccagatacagcagcggctttgcaagaccgcggaaccgctgatagttgatcttgccaatgaagagcatggccgccacgcccatgatggcgaacacgccctggcggataaagtaggacatggggttctggccgtccgtctcgtaataggcggaggggaagctggcggacagcagcatcaccaggcccacgccggtcaacagcatcaccaggatgaagaagggcaggtcaatgggccccttggccaattcccggctctcctgctccagctcccgccggcgctgctggcgctcctgccgggccagggcctcttcccgactcatgggtcgccggcgggccgccggggcttttttctgccgtaccatactgcttccctcctctcggggtctgtggatcttgccgcgctccgcagcgggccggcgcagagtgctcagaatcgtccctggacgcccagataggccaggacgcagcccgccagcgtcaccagggagaataccgccaccagcttcgcctcactccagccggagagctccaggtggtggtgcagggggccatcttgaagaaccgcttgccgtgggtcagcttgaagtaacccacctggataatatcggacagcgtctccagaatgtagatgatgcctacggggatcaacaccaggggcatatcgaacacaaaggccagggccgccaccgcgccgcccagaaacaggctgccggtgtcccccatgaacaccttggcagggtggtggttatagacgaagaaggctgccagccctcccgccatagccgccgggaacagagcctggatgccgtaggtgctccagaggacgccggctacggtgaagaacgccatcaccacaaaggtgacgctggcagccagcccgtcgatgccgtcggtcagattcacagcgttgacgcagcccacaatgacgaaggccgcgaagatcagatacacgatccagttgatggtaaagctcatgttcaggaaggggatatacaggtcgttggtcagcaggccctcgtaccgcatcagcaccaggaacaccaccgccgccgccagctgaaggatgaacttctgccgggccgtcagtccctcgttctggtgctggcggaccttgcggtagtcgtccacaaagccgatcaggccgaagatcagggcgaagagatacacgtagaggtgccagaacaccccctccagcatgaagctccaacccaggatgaacacggtgacgcccgcacccaggatgaacatgatgccgcccatggtgggcgtgccggccttggacttgtgccacgtgggtccgtcctcccggatctcctggccggccttcagcttgcgcagctccgggatgagaaatctgccgatgagcagcgtcagcacaaagctgacggccgccgcgatcaaagaaagtgtcatatatccgtctccctctccttcgccgggcacagccccggccctttggtacgttcctgattccagcggttctccggcggccgatcctccgccggatgtcccgccgtatcccattgtccatgcggcgccgcccacggctgaccgccgcatttcacgcggaccgcccgaagtgaattcagccgatttcaagggtttgcctgcggcaaaccgcttgacgccggacgcccggcggtcacttccccgccaagtgctccgccacgatctcccgttcgtccatgtggtgcttctcgtggttcacgccccacaaaatctccgattttgtggggaccccgcatttgactcaaatcgcccgaagtgaattcagccgatttcaagggtttgcctgcggcaaaccgcttgacgccggacgtccggcggttacttccccgtcaagtgctccgccacgatctcccgttcgtccatgtggtgcttctcgtggttcacttcctggtaggtctcgtggcccttgccgcacagggcgatcacatcgccgggctgcgcgtggtccatcgcccagtggatggcctccacccggtcgcagatcacctggtagggggtgccgctgccctccaggcccggcaggatgtcggcgatgatggcctccgggtcctcggtccgggggttgtcggaggtcaccaccacaaagtccgccagctccgccgccacgctgcccataataggccgcttggtccggtcccggtcgccgccgcagccgaacagggccacggtgcgtcccttggcaaagcccttcacggtgcgaagaatattctccagactatccggcgtgtgggagtagtcgatcaggaccgtgtagtcctttcccggtgtggggaccacttccacccgccccttcacatggggaactgcagccagcacccgggcgctcttttccagaggaacgcccagagccagagccgcacccagcacatccagcgtattatataccataaacccgccgggaatgccaactttgatgggcgtgcggctatcctttgtcaccgcatcgaaggcgatgtggtccgccgcaagggtgatatgctccgcccgcaggtctgccgcggcgtgctctgcatagaagtactgccgacatgcggcgttttgcagcagccgctctgtccagggatcgtcggcgttgcagacgcccacgtcgcagttctggaacaggatggccttggcgtcgcagtaggcttccatggtcttgtggaaatccaggtggtcctgggtcaggttggtgaaaatgcccaccgcgtagtggataccgtacacccggtccagcgccagagcgtgggaggatgcctccatcaccacatgggtgcagccagcggagcgcatccgggcaaacagctcctggagctccagggactccggcgtggtgcgctcagtgggcaccacctcatcgccgatcagatcctggttggtgccgatcaggcccaccttggcccccagctcctgttccaggatggccttgagcagataggtggtggtggtcttgccgttggtgccggtgacggccaccatggtcatgctgtctgccggatggccgtaatagttggcggccatcaccgccagggcccggcgagagttctccaccaggacatagggcacggagctgtcctccggcggtcgctcacacaccaccgcggcggctcccgccgccacagcctttccgatataggcgtggccgtcggtggcaaagccggtcatggccacgaagacgtccccgggtgccgtggtccgggagtcatagctgatatgggtgatctccgtctccatgtccgcggtagcggaccgcagggagagccctgccagcagcgttttcaaatgcattgtatgcacaccccttttgttcagtctggcagcagtttgccgtccctcattataaacaaggggatttgcaaagtatacggaggaaggtgccaaaaaccatgcagaacctgctttctcaatccaggacagagttgtcgccgaactggacggtcaccaccgtgcccgccgccacctccgtgcccgcagggagagactgggtaatggcgtagacattgccggagctggctgtggtggtaccggtcaccttcatgataagtccggcgttggtgatggccttgttggcctctgaggcgctcttccccaccacattgggcacggtgcagggggtgtccggcttctcctgccccaggtagaggatgatggaggcatttcccggcacgatggcgccgccggcgggggtctggtcggtgaccgtgtccccgtcccccacagtgcggaaggtgaagcccaggtcagccagccgatcttcagcggcctccctggtctgtcccaccacattgggaaccgtggtgtcagcgcccaccagctcctcggcggtgtaatccggctcaacgcccagcagaggcaggatctcgctcatgatctggctggccaccggggccaccatggtgccgccgaacacggcagtgccggtcgtgcggctgggggtgtccatggtcagcagcatgatgtactgtgggtcgtccgccggggcgaagcacataaaggacaccaccacgtccttggtgccggttttatccgcagtgccggtcttgccgccgatgcggtagcccgtcacctgtccgttgcggccgccgccgtcggacaccacccactccaggcactcccgcaccttggcggaggtctcctcactgatgacctgccgcaccgctgtggtctcgtgctgactgaggatgttgccctcgtcgtccagcacctgttctaccagatagggggtatacagatagccgccgttgatggtggctgcctgggcccggatcagctccaggggcgtgacgttgaaggtctgtccgaaggagtaggccgccagggaaaccacgttggagttgaagctgtcctcattggcaaagatgccttccgcctccgcaggcaggtcgataccggtggtctccatgaggccgaaggacttcagatagcggtagtatgcctccgtgccgatcttcaggcccatggtgacgaaggccgggttgcaggagttgccggtagccaccttcagggtctgggtgccgtggccggcccgcttggaacagttgatggcttttccccagccctccacgtggatggagccggtgcaggtgaaggtggtgttcatgttcaccacgccctcctccagggccgtggccagcgtgatgggcttgaaggtggagccgggctcgtaggtgtcctgatagcacttgttccgccactgcttgaactggatggtggcccgggcattcgccagcgcctgattgtacgcctcctccgtctcgtaggtgctgcggttctgctggatctccgccagagcggcatccaattccgcctgaagtccctcagtatagatggtggaaaagtctcccggatcatagttgggataggaggccatggccacaatgccgccggtgttcacgtccatgacgatgccggtgccgccgttggccgcgtcgtacttatccagcatactctccaggcccttttccagggcgtactggacgttggtgtccagagtcagcaccaagctgctgccattctccgcatcaaacatctgctcgccgccgctgaacaacaacggcgtgccgtttacgttggtaggcgtgatggtcagtccagtgctgccgctgagcacgtcatcataggacgcctccagcccgtaggcgcccatattgttggcattgacgaaccctatcacattgcctgccagagagccgaagggatacagccgcttggtgtccggcgtcagggagatgccttggagccgggtgggccgcccgccggtagagatgagaacggtgttgccgtcctcgtccaccgtggtaagctggttcccctcatcgtcgatctctccgttgatgaaccggcggacctcgtcggccacgtcctggtctaccttctttttgacctcccagtatcggttggcggtgttctccaggtgctccaggatggtctcctcctccacatccagaatgcggctgaggccccgggcgatatacgcctggtccagcacctccggcgccgtgtaaggcgctcccttctcggcagcctcctcggccgcatcctggatcttctgctcctgggactctacaaagtcctggacgccaccgggatccagtaagactgtctccgtggagtaggagatggccatgatctcgccgtttttgtcgtagatcgtcccccgggaggcgctgatgaccatgctgtcggtctgctggctcaccgcctcggccttcagttcgtcgtgccggttgatctgcagatcgtacagcttccaaaacagcactgtgaaggaggccacacccaacagcagcatgatgagcatcgtcctgccccggattacctggttcgcccggcgggcggcgtcgctctttcttctgggtctgtccgtcatgcctgttctcctttcggaacgccggggccgcttcccccgtccatacgcaataccaaagcaaggagtaagaaggcccccttcttactccccaccgttcgcttcattatagtgcggccgtcactcgaaatattccaccacggcgtagatcccgtggttcagcgaggtcagcaaacggctgagcagattggactcctcctgctgatagaccacggcactgtcgccctccgacagatcgatgtaatagatctggctgctgctgggcttgctcatgcccgccgcctccgccacctctttcacggtggccaggtcaaacatctgctcgtgctgggcggtgagtgtgacgttctccgtctgcagctcctccagctggttctggagggacaccacctcgtcggagatgatcgtcagctggatgtagcccatcagcaccatcactgcaaggccgatggccgcgcccacgcccaaaacggagaggacggacaccttctgccgctggcgtacctgcgccttggagaggctccgcacccggggcttcgccttggggacggcctctaccgccgtctggtgacggggagcctctccggcgtgccgaagagcgcgctcccggacttcccggtccaggtcgtacgccaagtccccatataccgcgctgcggctgttgtaccgcagttcccgcgctgctgccaaagaaggtccctccttttgctccgccataccggcacggagccgttctcacacacattaacaccggatggtcccggtgtggtcaaaggtcaaagccgaacttttccgccacccgcagcttggcgctgcgggcccttggattctcctccagctccgcgccgcccgccgtgacgggcttgcgggtcaccagccgcacctggggctttttgccgcacacgcacaccggaaactccggcgggcagacgcatccccgggccagctccgccagcgtccgcttgacgatccggtcctccagagagtggaaggtgatgacggccaggcgaccgccggggttcagcccgtccaccgccgcccgcagcatggggggcagggcatccagttcaccgttgaccgcgatccggatggcctgaaagctccgcttggccgggtgctgcttctcccgcagagctgcgggaggcatggcgctcttgatgatctccaccagctccagggtggtcttcacaggcgcggtctcccgcgcccggacgatggctctcgcgatggcgggggcgtaccgctcctcgccgtattcaaacaggatgcgccgcagctcctcctggctccaggtgttcacgatgtccgcggcgctcaggggggcggaggtgtccatccgcatgtccagcggggcgtcctgcatataggagaagccccgtgaggcgtcgtccagctggggagaggacacgcccaagtcaaagagcatcccgtcggcgccgctgacaccgcaccgggacaggacctccttcaattccgaaaagttgctgtggatcagcgtcacccgggccagccagggggccagacggtcctgcgccgcgtcgatggcggcctggtcccggtcgatgcagatgagccgcccggtggtcagccgaccggcgatctcccgagagtgtccggctcgtcccagggtgccgtccacatagatcccatcggggcggatgttcagtgcttggatgcaggcgtccagcagaacaggcttgtgcgtgtattccatcggcactcacccgcggctgcgccggacacgggccagggcgtccatggccgcggccatatcgtcgctctccagcatccgctgctcccgctccgtccaggtcttctcgtcccagatctcggcgaaggaattcaatcccacgatggtggcggtctttttcagtcccgcgtgggcccgaaggctggcagggatcagcacccgcccctgggcgtccggctcacactggacggcgttggcgtatagcagcgtcagcgcccgggcctctgtataggagaggtcgtccatctcctcggacatctggtcccacttggcctgagggtaaatggtcaggcagtgctccgcgccgatggtaatgtagaacgtgtcgcccagggcctcccgcatggcggaggggatcaccagacggcccttggagtcgatgctgttgttggattttcccaacagcctggccacggttgatcccccctttcccgcgttttttgggtctggatggggtctctttggcacttaatctctacttttacccacttttccccaccacatgctctgagtataagcgaaattggccgggattgcaagcagttttttccgggaaaaccgccgctaagaacgccaaattatggcatttttcggccaaaatcgccattttaaaacagatgttcgacatctctttgacaagtttacgtaaaataaaaaacaccccatgacgcaagaacttgtgccatggggtgctttttttcattttctccgcaacatctagagtattccaaaaaagtttcgccaaatcctttggcgtttttcacaaatttttaagattacggttgacctgcggcatcactcctcgccgccatcctcctggggcggggtcctgccgtccagcttgtcccgctgctcctgcattttggcagcggaggcactgcggaaccgcacccgctgctgcttcacctcatccagcgccatctgcaccgcctcctccgtgcgggccagggcgtcctcggcatactcattggtcacctggtacaactggcggcagcgctcctccgcccgggccaccatctggcgggccttctccttggccgcatagagcacctcgctgtcggacaccttggtcttggcatccagctccgcctgacgcatcatccggtccacgtcccgtttggcatcctccacaaacttgtcccgggcggagagcagctcctgggcgcgcttgatctccaccggcagctgggcccgcagctcgtccagcagatccagcagctcgtcccggtccaccatgctcatattgggtttcagggccggggacttggcgtcctcgatccgctcgtacagcatatcgatcaaacggttcacatcatttgccatgggactcatccttccttcttttccgtcatctcccgcaccagaggcacgatggacgcgggcaaatagttttcaagcggctggtgatagcggatcatctcccgagccatggaggagctgaagtgctgatatgccgcgctggcaggcagtagcagcgtttccagctccggatggatcccccggttgatgagagccatctgatattccacgtcaaagtccgtggtgttgcgcacgccccggacgatggcggaggcatggtgccgcaccgcgaaatccgccagcaggcccggccacagctccgcctccacattgggcaggtccgccaccgccgtccgcaccagctggagcttctgctccggtgtgaacatctggtttcgcttttcagcgttggggctgacacagacacagacccggtcaaagcaggcagccgcccgccggatgatatccaaatgccccagggtgatggggtcgaaagagccggagcaaatcgctgttctcatgggggtcattcctcgttttctcggtctccgccccggcggatcagcgtcagggcgatcctgccgtaacggtaggtgcggcgcacccggtagggcgccgcaggcgccggaaggctccggtccgccgggtgttctgccacaattataccatggggattgagaatgtcaaacgctgtcagatgggcgacggcgggctccagcagccccgcctcatagggagggtccagaaacacgatgtcaaaccgctcccgcagtgaccgcagaaactccatggagtcccccgccactacccgggcccggtcctggagctccgtcagcttcaaattctcccgaatcagcttcacggcgtcggcccgccggtccacgaacacggcagaggcggcaccccggctgaggcactcgatgcccagctggccggttccggcgaacaggtccagcacccggcgcccctcgatgtcgaactgcagggcgctgaagagcccctccttcacccggtcggtggtggggcgggtctccgtcccttccagctccttcagccggcggccgcgggcagtgccggtaatcacacgcatggtttttcctcctctcggtgcctccggttctcgcgggcgccggagatcaggtacaggatcagccccgtccagacgaagccgaacaaaatggcgtgggtggcggtgaatgcctctccatacagcgccacggacagcagcagctgcatggtggggttgatatacatcagaatgccggagagggtcattggcgtggttttcatgccggcggcgaagaacatcagcggcacagtggtcaccacgccggacaccggcagcagcagccactgccaaccagagaggaccccggcggcgccggtgccgtgggcctccatccagaagatcagcaccagggcaaagggcgccagggtcagcgtctccacaaaggtggagaccgccgcgtcggaacggacctgcttcttcagcgccccgtaaacagcaaagctgccgccgatcaccagggcgatccaggggatctgccggtagcggatgacagtgattaccagtcccgcgaaggtcaccgccaccgccagccactggagctttgtcagccgctcccggaacaggaccgtccccaacaggatcgccaggatgggattcatatagtaggcgaggctggagtcgatcatgtgcccgttggccaccgcccagatgtagacgccccagttgacgcagaccacgcagcccgcagcggccagcagcccccactccctccggtcccggaacgcggcccgcacaccggccagccggtcccgccgcagcagcaggatgcctccggtgagcaccatggaccacacgatgcggctggccagcacatacagggaatccacctgggccagcagcttccagaagatgggcagcaggccccagatgacatagcaggtcagcacatacagcgggcccttgtttttcattgggtcgctctcctttcccctccagccttcacctctgtggccttcagtttctgaaaaatcccgtgatttgtctattttacggcaagccgcggaagatttcaatagctttccgcgccggagccgggtcttttttagacttgtactttcacggggaatcgtatataataaggttctcaaagtacaggctgtggacagccgctgtccagagcaggcggcccgccgcccttcgtgccaaactcctgggaaagaaaggacgttctcatgattcaattcaagtctgaccacggcgatatcaccgtcagcagcgccgtcttctccaacatcaccggcatggcggccaccaactgcttcggcgtcaagggcatggcctaccgctccatgacggacggcctggtgcatctgttgcgccgggaggccatgagcaagggcgtcagcatcacttatcacgacgacaactccatctccatcgagctccacatcatcgtggaaaacggcgtcaatctccccgcggtctgccgctccatcatgaatgaagtgcgctatgtcgtcacccggaacaccggcgtcaccgtcaaggacgtggacgtgtgcgtggattccatgaccctgtgagggaggaacgagacagatgaacgaacaaatcaccggcgcactgttcaagcggatggtgctccacggcgcagccgtcatcacggcccagaagcaggccatcaacgacctgaacgtctttcccgtgcccgacggcgacacgggcaccaatatgtccatgaccatcggcaccgccgtgacggagctgcgcaagagcgagcccgccactgtggagcaggcggcctccgtcactgcctccgccctgctgcggggggcccgcggcaattccggcgtcattctctccctgctgttccgaggcctgtccaaggccctgaagggccgggagactgcggacgccgccgctttcgccgccgccatgcaggagggtgtctccgccgcctacaaggcggtgatgaagcccgccgagggcacggtactcaccgtctcccgtcttgccgccaagcaggcggtggacacagccgccgccggagagacggacctggagcgggtcctggaggacgccatccgagtgggctatgccgccctggcccagaccaccgagatgaacccggtgctgaaaaaggccggcgtggtggacgccggcggcaagggctatctcctgatcctggacggcatgctggcggaactgcggggcgagcccatgcccgagacggaggctggcgagtccagagaggagaaggcagacttcgccaccatggcggcggaggacatcaccttcgccttcgacacggtattcatcgtccgcaaggccatggccgatatctcgctggagccgctgcggacatatctcaacagcatcggtgacagtctggtgatcggcgaggacgacgaggcctttaaggtccacgtccacaccaacatccccggcaacgccctgaacgaggcccagaaatacggtaccctggagctggccaagatcgagaacatgcggacccaggcggacgacctggccgcgggcaagcacgtccagagcaccgatgacctggacgcggtggaggcggagctggagtccgtccccgtggaagaaacgcccgccgtggcggcgccggagaagccctacggctttctggcggtgtgtgctggggacggcctggccgccgtgttccgggacctgggggccgacggtgtggtgtccggtgggcagaccatgaacccctccaccgagagtattctggagggcgtgaacaagatcccggcggagacggtgttcgtcctgcccaacaacggcaacattattatggcagcccagcagtgtgccgccctgacggagaagcaggtggtggtgatccccaccaagaccgtgccccagggcatcaccgccatgatgaacgtggatttcgacgcgccggatgcccagaccattactgacgccatgacgggaagcctcagctccgtcaccacggcccagatcacatacgccgcccgggactccgacttcgacggcttcgccatcaaggagggcgattatctggccctggaggaaggcaagctcttcgacacggacggttcccttgacacgctgctccacaagctggcggaggacgccgccgggcgggaggcctccttcatctccctgtacttcggcgaggatgtgcaggaggcggacgctcagaaggccggggccctgtttgaagaggtgtgtcccggtgcggaggtggcggtcctctccggcggacagcctgtgtactattatattatcagcatggaataaagcatcaggaggtgtttctgtttctttcaagcagagacacctctttctttttgaaaaggaggcgccctatgaagacctggaagctcctgctgctggccctggtgcccggcctgtggggctggctgtgcaactggctcaccgccgtgtccctgaacggccctgccttcctgtttacactggcattttatatccaggtgcctgcagccatcgtgttctgcctctggctggggcatctgtgcggccgctccgaaaggagctaccccgcctgcctgctgctgacccagtggcccagcctggtgagctttgccctgtacgtgtggcagttccactttgtctccagtgaggcccggagcttcctgctggcggggctggggcagtaccccggcctcccgctgttttccctggcctgccggctggtgatccccttttccaatcacagctgggggccgccggaaaccttggcggccaatgcgctctccctgctgatgctggcggtgctgttctccctgggcttcctatggggccggcggaggcggtgacccggccccctctcctgaaaaatgccccagcccgggccgtcaggcccgggctggttctttaatgcctgtaccagatcagcatactgagttgagtctcctccgtccccgggttccggtagcggtggggctggtccgccgggaagcgcagggagtcgccggtccggagccggtaggtctcccccggcaggccgatctccgcctccccggcgaagacggtcacatactcctccgtccccggcagatggggctgggcctccagtgcgccgccggggagcatcacgatccgataggtctcgaacccccgctccccgtcaaaggggaaggccgggcagttccggtacctccccccatcctcctccagaatcggcgcgtcatcgccccgcagcagcaccggccgctcccgggccggctccaccagcgaggtgaaagacaccttgtaaccgttggcgatcttccacaccatggagatggtggggttcacgtcccccttctcgatctgggccagcatactgcgggacacccccgttagacgggcggcctcgtccagcgtcagccgcttctcctcccggagccgccgggcgttctccgacaccactgcgttgatctccaaacgtttctcccctctctattgacaagatattagatgaatcatataatatacaggaaatccagtatcttgaaaaaattccattggatattgtactgcacccggaaacggtccgtcaagagcggtgcggtagtttcccggcgcggcaccaaaaggaggagtcgtatgcgcagactgagagccgccgcactttccgaggtggagctggctatggacatcatcaaccaggccaaggcccacctgcgggcacaggggatcgaccagtggcagacgggctatccggaccgggactgcctggaacgggacgtccgaacgggaaaagggtattttctggaggaggacggcatccctctaggctacctctgcgtcgatttcgacggagaaccggcctacgaccatctgaacggcacctgggcccgggaggagccctatgtagtggtacaccgcctggccctatccgacgcggcccggggccggggcgccgccggtacggccttccagctggtggaggacctgtgccgggatcggggggccgggaatttcgggtggacacagacgcgggaaatcataaaatgcagcatatcctggccaagcaggggtttcagtaccggggcaccatccggttcgacaacagtgagaaaatcgcctatgaaaagctcctctgaccgccctccaccgctgaatcaggaacagccggcccccaccagggccggctgttctcagttttccatacagggttacagggccgccatctgggccgccacgctctcctcgcagctccgctgagcctggagggttttttccatcagctcttccagcgtccaccccagccgctcagccccggtcttgatgacgtcccgggagcagccggcggcgaacttcttgtccttgaacttcttcttcagggagctgacctccatgtcctggcagctcttgctggggcgcatcagcgccgccgcgccgatgaggcccgtcagctcgtccgcggcaaagaggaccttctccatctcctccgtgggctccacgtcagagcacaggccgtatccgtggctgcatacggcgtgaatgaactcgtcgctgcagccgatctccgccagcagctccggagcctttttgcagtgcgcctccggccacttctcaaagtccacatcgtggagcaggcccacggcggcccagaaatccgcgtcctcgccgtaacccagctcctgagcgtaccagcgcatgacgccctccaccgtcaggccgtgctggatatggaagggctcggcattgtacttgcgcagcagcgccagggccgcgcttctctcgggacatgctttcatctttgatcgctctccttttgtaaaatcagaccggggcagcatcccggggatccgggtcgccctccagggtgacgaagtagtcgtaatagggcagcaggaaggtgaagtcctgtctcaggcgctccacgatgtcccggctgaacagctcgtccgtcagcttgtcattgtgacagatggtgaagctcctggcccggtaccagggctccagcagtttggaaggggccggggccctggggcgcttgtagtcctccgtctccaggacaagttccttctggcggttcagcttccgcatcagcttctccatggcggcggggtcccggtcgatccgggcccgcagcttggccatcgtcagcggcttgggcatataataccccatgccgcaggtccacccctccggcatcagctcgaaccagaaggtggggtgggccgtccactcctccgagggctgctcgatagagaaccacaggctctccttataaggcccccggccgtggagccgccggacgtcccggtagatccgggtcaccttgcggatgagccccagatccggccgcttggcggcgatgtagtcatagagctcgtcccccagctcccgcatgggctgataaaagtgcgtcagataaatctccttgtgagcttcaaaccaagcccgctcgttgttgaagcggatgccccacataaagtccacagtctcgtctgtaaagccggtaaacatcccgttcctcccgctggatttcaaaatttaagatttagtataacacattttccggccatggaaaagaggggaacggcgttttttcggcgcccttcccctctttccgctcacagcgcccgctccagcagggccatcagctggtccgcctgacggtaggattcctctcccagctccttcagcagcctccccaggcaggggtctgtggtctcctcccccgcccgcaggtagttcatgccgttgcaggcctccacatggtaccgctcccgcagggcggggcaccagctatctatggaaatccgtccgctggccaccgccgggcggtagcagttcccagtgatgaggtagtaggccgtcatcagccgccgggcagctgcgcccgacgcgtttgccaaatcccgcatcgtcccccgggcgaaagccggtgcccgccgggcgaatgcctgataggtccgccggtctgccagctccacctcgatgaacccttcgatcactcccagttcctcctgcgccatggtgcccatgcagcaggggttctcctccgcaccgggcaggtgctccaagtcctcaccggccggcggctgggaagcccgcggtgcggcaccagaggccaggggcgccatcgcgggcaccgccggctcccgcaggtcgggatagggctccaggttgggggccacccgccgccagatctggtcgtatttccggaagtcataggtctccggagtatgtatggtctgttccatccaggtccctccttttctccccagtgtatgcgctttggaaaaaacggttcctgttgcaaaaatcacacgtatgaaattcgccccagggttaaaatatcataggacgagagttccctttttcattgctttttcccgttgtttctgttaaaatagggaaactgcgaggattgatgccagcaaaggaggttccgattgtatgctggaattgaaacatatcagctacgccgtccgggagggcgacagtgagctggggatcttaaacgacatctccctgaccatcgacgaccaccgactggtggtgttcaccggtcccaacggcggcggcaagaccactctggccaagatcatcatgggtctggtgaagcccaccggcggccagattctgtggaacggtcaggatatcacggacctgggaatcacggagcgggcccgtctgggcatcagctacggcttccagcagcccccccggttcaaggggctgacggtccgcaacctgctgaccatcgcctccgggaatgagaagctgtccaaggaccagtgctgccagtacctgacgaaggtgggcctgtgcgccaatgactatctggaccgggaggtggacgcctccctctccggcggcgaggtgaagcgcatcgagattgccaccatcctggcccgcagcagccagctgatgatcttcgacgagccggaggcgggcatcgacctgtggagcttcgcccggctgacagagacgtttgaacagatccacgccagcggcaccgcgaccatgattatcatctcccaccaggagcggatcatctccctggcagacgagatcatcgtggtgggcgacggggagctgcgccaccggggcacacctgaggagatcctgccccagatcctggcggacaccctgtccgggtgcccggtgctgacgaaagaaggtgctgctgtatgatggacacacaggtggaccgggagctgctggagaagatcgcggacctgatcggtaagcccgtgggggccttcaacattcgtaaggactgcggctgtgacggccgggtgtccacggagcacatcaagatcgacgaccggaccgacggccacgccggcatcgacatccggattctggacgggaccaagggcgagacctgccacatccccgtcatcatcaccaagtccggtgtggaagagacggtgtacaacgacttctacatcggcggggactgcgatgtggagatcgtggccggctgcggcatccacaactgcggcgaccaggagtcccgccacgacggcatccacaccttccatgtgggcaaaaactcccatgtccactactcggaaaagcactacgctgagggggacggcaggggcgagaagatcatgaacccccagaccatcgtgtatctggaggagggcgcctccatccagatggacacggtgcagatccggggcgtggactccaccaagcggtacaccaagatcgtctgcggcaagggggccgaggccgtcatcacagagcggctgctgacccacggccgccaggtggcggacagcgacatggtcatcgagctgaacggtgaggacgccaagggccgggtcatctcccggtctgtggcccaggacgagtcctcccaggtgttccgcccctgcgtggtgggcaacgccaagtgcttcggccatgtgcagtgcgactccattattatgggacaggccaagatcagctccgtgccggagatcgccgccaacgacaccgaggcccagctgatccacgaggccgccatcggcaagatcgccggggaccagctgctgaagctggagaccctgggcctcaccgaggaggaagcggaggaccggatcctcaagggatttttggcataaagacagaccgcggggcggctggccggagggccggccgccttttttgcttccccgcccccagagagggggctttcttccggaggcgccgcaggggcggcaatctgccgcccgggtggattcagccatgaggatggctgggcaatgcccggtccaaaagaaaaggccgcttttggcgcacgccggcgcattcgcgcctctgtgctgacgggggtcggcgtatcggtgcaagcgccgatttgggcttgccttcgggcacgctatcatcttctgcgaggtcgtgactgctgtcccgtggcggatggtgccgacagcgtcggggtgcaaggatgcattcgaccagcttctctttctgcgccttccgcttcgccaggcgctgcctgcttcttcgcgggagcgtgagcggcagcggggagaggggcagggggtatccctgtacctccccgggctggaggtttccccaagggcggcgcgtttccgtctctgactgccgcaagggactgccaaccttcccccgccggcggcaggagggctgcgcctgcgcaggccgacccgccgaacatgttttcttttccaccgggcgcggcgcattttctttttgatgtctcaaaaagaaaatggggcgcgcatcccctgcgggagcggaatcccccgcggccgccgttcggcggcccatccctctccctgccgggatggagaatttttttcaaatccgtgtaacgaatcccccgccagccggacatacctgacagagaggagggagatgcccttggccaacatggaagaaatttaccaggcccatgccaggaccgtctataaatttctcctctcccagtgccatgacgccgacctggcggaggagctgacccaggagaccttctaccaggccgtccggtccatcgaccggttcaacggctcctgcaaggtgtccgtctggctgtgccagatcgccaagcacctgtggtaccagcacctgcggaaacgaaaaccggaggagcccctgccggaggacggcctgccgggcccctccgcggaggaggacgtgctcacccggcagggccatctggacctgctgcggcagatccatgccctgccccccagcacccgggaggtggtgtacctccgggccttcgggggcctcagcttccgggagatcggggacgtgctgggacggacggagacctgggcccgggtgacgttttaccggggcaaggaggcactgcggaaaggaggagcagaccatgaagaacattcctgaattatcctgcgccattgtggaggacctgctgcccacctatgtggagaggctgacctcggaggaaaccaacatggcggtggaggcccatctggcgtcctgccccgcctgtgcggccaagcggaccgccatgggggcgaaggaaacggaagcggcgggtcaaaacgccgaagagaccgcccgggaggtggactatctgaaaaaggtgcggcgcaggaaccggcggagagtatggctggcggtggcctgcaccacgctggtgctggcggcagtgattcttacaaaaatcttcatcattggcgggccgggacaagccaatgatgtgggggttcgcctcgtggaaattgtggatggggacaccctgtctgtcaatgtggactgcctgtatgctgtcaatgccttctacggctgggaacaggatgagacagaagatggggttgtttctttcaccgcccgtgaagcgagagcctctttcattcacccaaacgatctagtagaccttcgggtcccactggaggggcttaaggaagtctgggtctgtggcaggctggtctggcagaacggcaccactattcttgaatccacactgtggatctacgacgcccgcaccccctatgtaggcgacgccactgccgtggggaacctggtccatgagatcggcctctggctttccagtatggagctcccctataactacaccatcagcctgcaaaccaccagcgagccctatggcctgaccattcacttcgacagcgtcaccgctcatgtactgggtgtggagcgcgacatcgacaagcggatgtatgccatcgctccctccctgctggcgctgatcggcaacctggggcaggtgcagtggacctacgccgccccggacggcaccgcagtgacccgctctgtgacactggaggaagtggaccaggccctgccggattggatcgaagcctacaatctggatgccggcgcggattggactgccccggagagtgtcaaggattacgccacctcaccggcagccctgcagcagctgctggacctgacatgtcacggcttctatgtggtcacggaagaagatggaaccaccattttcaccccgcaattctaaaacagcgtcagaagtgccccgtctcaaaggagacggggcgcttcttttgtgcaaatgaagccggctcattcaattcccttgccgttgttccacttccactcccggatctccggcaggtccacgccgtgatccttgatatactggcggtgctccaccagcttgtcgttcatccgctggaccagataggcccccggttacccagggagtgcagccgctggaccacgtcgatcaccagatggaaccggtcgatatcgttgaggacccgcatgtcgaagggcgtggtgatggtgccctcctccttgtagccacggacgtgaagatgcttgttgtgccggcggtaggtcagctcatgaatcagcgtggggtatccgtggtaggcgaagatgatgggcctgtcctgggtgaagagcatatcgtactccatgtccgtgaggccgtggggatgctccgtgtggggctggagcttcatcagatccaccacgttcaccacccggatcttcagctctggcagctccttccgcaggatcgtcaccgccgccagcgtctccagagtgggcgtgtcgccgcagcaggccatgaccacgtccggctcctccccctggtcgttggaggcccagtcccagataccgatgccctgggtgcagtgcttcaccgcctggtccatggtgagccactgggggcggggatgcttgctggccaccatgacgtttacatagttccggctcttgatgcagtggtcgaacacgctcagcaggcagttggcgtccgggggcaaatagatgcgcaccacgtccgccttcttgtttgccacgtggtccaggaagccggggtcctggtgggtgaagccgttatggtcctgctgccacacattggaggagaggatatagttcaaagaggcgatatcctgccgccagggcagctcgttgcaggtcttcagccacttggcatgctgggcgaacatggagtccacgatgcggatgaatgcctcgtagctgttgaagaagccgtggcggccggtgagcaggtagccctccagccagccctcgcacatgtgctcggacagcatggagtccatcacccgaccgtccgggtccaggtgctcatccgggtcctcattctcgtaccgctcccccaggaagcggcggccggtgacctcaaacaccggatggagccggttggaggccgtctcgtccggggcgaagatgcggaaattccgggattccaggttcagcttcatcacatcccggacgtagccgcccagcaccagcatgtcctgggcctccacctcgccgggggcgggaacctccaccccgtagtcccggaagtccggcgtccgcaggtcccgcagcagcaggccgccgttggcgtgagggttggcacccatgcgccggtcccccttgggggcgaaggagcgcagcagatccaccggccgtccctcctcgtcgaacagctcctccgggtgatagctgcggagccactgctccaggatgggcaggtgcttttccgtgtcagggcccatggagatgggtacctggtgggcccggaagcagtcctccacggggtttccgtccacctccttggggccggtccagcccttgggggagcggaacacgatcatgggccagcgggggcgggtggtgtctcccgtggtgcgggcgtgctgctggatgcgcttgatctcccggatggcccagtccagggtggcagccatctgctggtgcatcttctccggctcactgccctccacaaagcggggttcccagccgcagccgcggaagaactgctccacctcctcatgggagatccgggagaagatggtggggttggcgatcttgaagccgttcaagtgcaggatgggcagcaccgcgccgtcagtgatggggttcaggaatttgttggagtgccaagatgtggccaggggcccggtctccgcctcaccatcgcccaccacgcaggcggcgatgagatccgggttatccgccacagcgccgaaggcgtgggccagagaatacccaagctcgccgccctcgttgatggagccaggtgtctccggcgccacgtggctgggcacgccgccggggaaggagaactgcttgaacagtttccgcatgccgtcctcatcctgggtaatgttgggatagacctccgtataggtgccgtccagccagtcctgggccaccatggcgttgccgccgtggccggggccggagaggtagatcatgtccagatcgtccttctgaatgacccggttcaggtgggtgtagatgaagttctgccccggcacggtgccccagtggcccacgatggtctgcttcaggtcggaggcggccagtgggcgcttcagcaggggattgtccaacagatacagctggcaggcggagaggtagttggacgcccgccaccaggcgtcgacctgtttcagctgcgccggcgtcaacggcggctttttagacaggcgtgtattggttttaggctttgctgcaattgtcttttgagaagtccgtggcatattattacctcctttttcttgttcctttcgcaattagtatatctcttatttgaaaaaaggcaagcgaaattgaaaataattttatcttaatttacaattatttcattttagcattcctcttttaggcgttttacccttattctatcccttccgccgcgcttgcgtttttccgccggatgtgctactgtaacggcatggaaacgtatgaactcatccgctccggccggaagaccctggccctggagatcacaagggactgccgcgtggtggtgcgggccccccgccgcctgtcccaggcccgcatcgacgactttgtggccagtcacgccggctggatcgcccggcacctggaacagcagcgccgccgggctgccctggccccctccgcccccacccaggcggagatcggcgccctgaaggaaaaggcacggcaggtcctgccgccgaaaatcgcctattacagtgagaaaatgggcctgttccctactggcgtcaggatcacctccgcccgcacccgctacggcagctgcagcggaaagaacagcctgtgcttctcctgttttctcatgaactgtccggatgcggccatggacctggtggtggtccatgagctgtgccacatccaagtgaaaaaccacgggccggatttctacgcgctgctggagcaggtactccccgactggcgggagcggaagaagctgctgcgataacgtgtaaaagcacaaaccggaggcatggcttggccgtgcctccggtttatgtctgatattacgcccccaccgacgtgagccagaccgccgccagcagcaccgccagcagcgctgcattccaggcggtaaacaccgccagataccgggcggggcgggcccccggggagcgaagatacagcttgagcgtgatcaaacttgctagggatgctaccggggttcccagaccgccgatatccacgcccagcaacagctccctccaattgtccgtgaagcccgacagcagcaccgccgccggtacattgctgatgatctggctagtgagcacgccggtcagcaaggtgctgcgctccagcagactctggagaaacccatgaacggcaggcagccgtcccaggtttccggataccacgaagaagcagatgaaggtgcacaacaggctcacatccagcttccgcagcagagcaggttccactgcggccagcgtcccaagcaccagaaccgtcagcagaccatagggcagaatgcggaacaccgtcagcaggcacagcaggaacagtgcgccgtacagggccagcttcccgggctgccgcaggggctgcgggtgcaccggagggatctggagatccctgggcaggaccggcaaggccgccgcggtcaggcaggccagactgatccccgccaggggcagcaccaccgggaaaaaatccccggcagagagtccataggccccgtaaaggtagaggttctggggattgcccaccggcgtggccatgctgcccaggtttgcggcaatggtctgcagcaccagcagcggcaccgctgcggcccggcagtccatctggtccagaagcagcagcgcaaagggtgcaaaggtgataagagcgacgtcattggtcacggccatggagcagaaaaagggcagcagcaccaggatcactgccagggccctgggtccggtcccccgggacagcagatggccggccagccactggaacgccccgcaggactggaagcccgccaccaccgccatcaggcacagcagcaggcatagcacccgcaggtcgatgtagcccagataggcggcgtccggcggcaccaggaccatggtggccagtgcgcagagtgccgccacggtcagcaccgcctcccgcttgaaaaatgccaacagtctcatttctgtccctccaaaggctgacaaaatccgcgttccaccatatcacactttttccgggaacgcaaacctttttggggaggctgtgctgttctaccgcaggcagcccgctagccgccgggacagcatccacgccaaggccagcttcaccaggtccggcaccacaaaggggaacacgcacattcccagtgctgcccacaggccgatgggccccgccgcccgggcataggccaccaggaaccaggcggtgccgaaggcatagcacaccagcaggcccagcaccatggccgcggccgtcaccgccggacggtcgcccagccgggcggtcatgccccaatacagcagggccgaggccagaaaacccaggatatacccgccggtggtgcccagcagaacgcccgggcctccctgaaagcctgagaacaccggcaggcccaccaggcccagcagcagatatgccaggatagccaatgtcccccgccggccccccagggtccccagggctgcaaacacgccaaaggtctggagcgtgaacggcactgtcaggggaatgttgatccaggcgcacaccatcagcagcactgcgaacagggcggcgtacgccaggtccaccgtccgcagccgggtcctagtcttggaagtctgtttcaaatcagatcgctcctctcctgtgtctggaggaagtatagcaaggctttccataattgtcaaccttaaaaaaataaagtttacaatatagataaaaaaccaggaggcagtgcctcccggttcagcagtccgtgtgggtgcagatctcccgcaccttggcctgaatagctttcaggtccacaaaggtctccggccgcttctccacatcccgcagcagcgcggagggatggtagatagccgtcatctggacgccgccccgctggaaccacttcccatgctcggcggtgatcttgaagtcctccttgatgatagccttggcggcgatccggcccagacagacaatcagcttgggccgcagcagcgccgtctgccgccggagccagccgatgcaggcgtcctgctccacattcagcgggtcccgattcctgggcgggcggcacttgacgatgttggccacatacaccttcgtccggtccaggccgatgatctccagcatatcatccagcagcagccccgccggccctacgaaggggatgccctgctcgtcctcccgctgaccggggccctcccctaccagcaggatctccgcgtcccgggcaccgtcaccgaacaccacgtggagccgggtctccgccagggcgcagttccggcattgtccgcaggcctgctccagcgcctcccaggtatccgccatccgcctccccctccttcgtgcctctctccggggcaccacaccggcggcggatgcccctcggccgcccagccaaatggcagcggcctctttgcggccattgtaacacaaaatcttccgccgcgcaatgaggtatgaatctcttccgtccggacagactggacagggagaggagggggacgcttgtctctgtggctatggacattttggacatacagctttctcggctatctgctggaacgggggtacgccatcgccacccacgcggaccggcaggcccggaagtgctttctgctgctgcccatgtgcccggtgtacgggctgggggccctggcggtgctggccctgccggaatcattgagcggcagcttctggtctctggccctgtggggcggtctggcggccacagcagtggagtatgccgtacacgttctctatgaccgtctgctgggtgtgcggttctgggactactcccaggtccggtggaatctgcggggccgggtctgcctgcccttctccctggcctggagcctgctggtggcagcagggctgccggtgatccaggcagcgatagccccggcgctggccgccgtgccgccaaccgccacctatgccgcgctgctggtgttcaccgccgacacagtggtctccctccagctgctgcgccgggcaggagatcccgcagtgctgtctctgggaaatctgcgggctgcgtaagaagccgggcatggggaaacgtccatgcccggcttccttttgcgtccggccggtcactgttccggcaggtgggcctccagccagtgcgccacgtccgcatagaccttctcccggcccgtctcctggaggatctcatgccgcaggccctgataaagcctgatctccacgtcccggacaccggagcggcggaagctgcggtacgcccgccggacacccttgcccatgtccccaccgggtcgtcctgcccggagaggaagaggaccggggtattccggttcatccgcttcaggttttcttgcttctcaatgcaggcgatcccccgcagcatctcccggaagagtccgatggtggggtcccctccgcagaggggatccgcaagatactggtccacgttctccgtgctggcggagagccagtcgtatcccgtgcggttgggggcaaatttctgattgtatgcctcgaaggccagtttgttcaccaaggggctggaatggcggtcccccacctttctggcctcccgggcggccaggacgcggcccgccgccaccagcgccgggggcatctgccccgtgcccatcaggatggctccggccacggtgccggggtagcggatcagatacgtccgggccaggaaggaccccatggaatgccccagcaggaacaccggaaggccggggaaccgctgccctgccagctcccgccgggcatagaggtcctgcaccgcccagtcccagctgcccctgggtccgaagtacagccggggcgcccccgccgccacggagagaccgtgccccaggtggtcgtggcctgccacggcaaagccccactccgtcaggtaggccgccaggggctcataccgcaggatgtgctccgacacgccatgggagagcaccagaaccgcccggggtgccatgtccggcgtccactccaccgcatggatgccggtccgcccgtctgcggaggggaaggtaaattcgtttctcaccatggaaaaatcatcctctctgtgctatactgtgtgccatcaggcgtaggatgcctgctttccgggtcgatgataccacacttccgtcacaaacgccagaggaggccgcattcatggaaacatacatcgctgccctggaccagggaaccaccagctcccgggccatcctgttcaaccgggccggggagatcgtctcccgcgcccagcaccccttccgccagatctacccccagcccggctgggtggagcacgatccgctggaaatctgggccacggagaagcgggccctggcggaggtcgtgggcgccgcccacatcgaccccaagcggatcgccgccctgggcatcaccaaccagcgggagaccaccatcctctgggaccgctccaccgggcagccggtctgcaacgccatcgtatggcagtgccgccggaccgcttccctctgcgacacgctgaaggccgacggcctgggccccctggtggcggagcggacgggcctgctgatcgacgcctacttctccggcaccaagatccggtggctgctggaccacgtccccggcgcccgggaacgggcggagcggggggagctgtgcgccggcacggtggacagctggctcatctggaacctcaccggcggggcagcccacgtgacagactactccaatgcctcccggaccatgctgttcaacatccacaccctccaatgggacgaggcgctttgccgggcgctgggcatccccgcttccctgctgccggagccgctgcccaactgccatctctacggccgtgtggccccggacattcccggactggaggatctggcgggcatccccatctgcggcagcgccggggaccagccggcggccctgttcggccaggcctgcttcacgccgggccaggcgaagaacacctacggcaccggctgcttcacgctgatgaatgtgggcggtgagccggtggcctcccagtcgggattggtaacctccgtggcttggtccctggggggcgagactacctatgccctggagggcagcgtgttcaacgccggcagcaccatccagtggctgcgggatgaactggggctcatctcctccgccccggagtgcgaccggctggcggagagcgtgccggacgccggaggcgtctacgtggtgcccgccttcaccggcctgggcgccccctactgggacatgtacgcccgtggcaccatcgtggggctgacccgtggcaccaccaaggcccacattgcccgggcggtgctggacgccatcgccttccaggtgacggatctggtacaggccatgaacgccgacgccccttgccccatcaccacattacgggtggacggtggtgcctccgtcagcgacatcatgatgcagacccaggcggatctgctgcgactgccggtggaccgacccgcccaggtggagaccactgccttcggcgctgcagccctggcggggctggcggccggagtgtggggcagtctggaggaagtggctgccctgcgccgcagccagcacgtatttctgccccagcggccccaggccgcctgcgaggcccagtaccgcctgtggcgccgggcggtggaccgggcgttgcggtggattgaaaacgatgtgtaaacaaatccggaatttgttgcgttcagtggaaaagtgcgctatactgaagccaagtgagaggcatgaaacggaaatgaagacgatcagtgcggcgtttcgtccgcaggtgaaaggagtttatcgacatggctttttttgaggatctgaccaaaaagacaaaggacctggcctacgtggccgccgacaaggccaaggatgtggccgccgtggcagcggataaagccaaggacgcggcggagctgacccgcatctccatggccatcgccggggagcagcgggagatcgacaagaactaccgcaccataggcgagtggttcgtcagcgagtacgagggggagatccccgacgccgtccgggacctggtagaggccgtcaacacctctaaggccaagatcgccgagctggaggccagcaaaccccgtaaggacgatggcgccgaggttgaggcagcagctcccgcccagaagatctgccccatctgcggcgcggcctctgacagcaagttctgcccccagtgcggcgcccctatgggtgactgagttcccgccataacaaagacaagcccgccggcctgatggccggcgggttctctttctctttcaaaaggtcaggcgcatgtcataccataccacgccgccgtgggtggactgggagacgccctcgttcacaaagccgaatttttcgtagtagtggaccagcttgtccttacaggtgaggacgcagccgcgtcttccctgggcccgggcgtcggcaatcacccgctccagcaccgctccggcgcagccccggcggcgataggccggcagggtgttgacgccgaagatcatctgccaggtgccgtcctcgtcgtggagggcggcgttttcatacatctcgtcccggagcgtgggctcgtcggtggtcatgccgtccacaaagctcaccagcgtgccgtcgtcctcctccagcagccagaagtggtctgcgtagtaggccagacggtctgtgatctccgccgccgtggcagcctccgctggtgggaagcaggcggcctccaccgccgccagggcagccgcgtccgccagagaggcagtccgaatgtgcatgaaaaaatcctcctcatttcaaataacggtaagtcagcagcaaccgggcggtgccgttgaactggttttccagccagaagggctgatccgccgcgaaccgcagggcgtcccgctccagcagctggaagtcctgcccctccgcgtggagcagcaccgtgccggagaggctggtggccaggcacacgcagccgggcaccataggttccggcgcgtaccggccgctgatgtacaggtccagaaagaacgtctcctgccgcaacacgttgtcatagggcagcgagggccgcaacagcgccttgcccccatccagccgggcggccttgttgtccagctcccgcagaagcagcagcggctcgaagtcgtcgttctccagcagcacctccgccgggacctttaatgccccggccagcttgcccagcagccccacagaggggttggcctcccccgctcgatctgccccagcatggagcgggacacgccggcctccgccgccagccgctccatactgagcttcttgctcttgcggatgcgcttgagattctcccccaccgcccgggtcagctccatggcgcgatctcctctctcggccaaaaaggccactatgttgcacaatagcggttctatagtatccggtttgtcggattttgtcaagaggaaagcgggacagccctgctgccccgccgggcaaatttggaaaaggacttgcaagcgaatcccaatcgtgatatcatcgatatgaaaaacaaaaatgcggcagtttccaggtgcgccaacacctggaaacctatgcaggtgatgatgcacctacacaacggccgaaaggccgcaccgcatgaattatgatacgacattccggcctttttgtaaagggcggcttttctcgttatccattcatgcctgtgttgcacaagaagtctcttcttacgccgtgtaggggaaaccctgcgtggcgtttttgtttttcacccgccgcctggaggcgccagcccccggggccggtgcggtgaaaaacagggagaggcggtatcccgcttccctgtgcagttttgagaaaaagggaatcctaaaaattattgcggaggagcggtggtatgattattctgggagatttgcagcttggtcacaaggatctggatacatggaagccaggtcccaacagcgcgggcggtgtcagtgtacagattatctttcaaaatgacacgcagaaaaccatcaaatacgtctactttgatgtggtcccctacaacgcggtgaaggatgcctaaagctgtaccatctccggcaagaccaaggccggactgaaatgtaccgggccgattcagccgggcaagattttccgggacgtatgttgggaaaatgtctggtacaactattccattacaacgctggacctggtcatggtggaggtcctctacatggacggcagctcggaaaagctcaccggagccaacatcaagtacggcgatcctcccggctgctacatagccactgcggtgtatggctcctatgactgcccccaggtgtggaccctgcggcgtttccgggatcataccctggccgcctcctggtacggccggaccttccttcatgcctactacgccgtcagccccacgctggtaaagtggttcggccggaccgcctggttccagaagctctggcggggccccctggaccggctggtggcaagactccgggacgagggcgtggcggacaccccctatcaggaccgggagtggtgaccccgaaaacaaatcctccccgttatcaaacggggaggatttttctgtctgtattgcgtttagacccgcttccagcttgcgccgcccttggtgtcgatgatctcgatgccctgggctttcaactcatcccggatgcggtccgcctccgcaaagttcttcgccttcttcgcctcgtaccgcgccagcaccagcgcatcgatggccgggtccccctcgccggtgacggtgtagccgctctcggtttgggtggtcttggcctgggcggcctccgcccgcttggccgccgccttctccagcaggcccagggacagcacgctgtcaaagtccccgatcagggccagcttggtggcgtcgttggtctttgccttcagcacgtcgaacagggccgtcacgcccatggaggtgttcaggtcgttgcccatctgctgcccgaacttctcccggtagggcttcatggcctcctggtccaccggaccgtccgccgggtctagggccgcgatgcgggcgatcagcttggtgtaggccgccgccgcgttgtccaggttctcccaggtgaacaccagcgccttgcggtagtggctctggaggcagaagtaccggtaggccagggggtcatagcccttctgctccagcaaggacacagtgagaaactcacccttggacttggacatcttgccgtccgaggtattcaggtgatggacgtggaaccactgggggcaccagggatggcccaggtagctctcgctctgagcgatctcgttggtgtggtgggggaaggcgttgtccacgccgccgcagtggagatccagatactccccattgtacttcagggagatgccggagcactcgatatgccaccccggataccctacgccccagggggaatcccacttcagggcctggtcctcgaacttgctcttggtgaaccagaggacgaagtcgttcttgttgcgcttgttgggatcctcctccacgccctcccggacgcctacggccaagtcctcctcgtcgtggtcgttgaagacgtagtaccgccccagcttggaggtgtcgaagtacacgttgccgccggcgaagtaggcatagccggtatccatcagcttggagacgatcttgatatactcgtcgatgcagccggtggcgggctggaccacatccggcgtcttgatattcagcctgcggcagtcctcaaagaaggcatcggtgtagaactgggcgatctccatgaccgtcttgtgctcccgcttggcgcccttgagcatcttgtcctcgccctcatcggcgtcggaggtcaggtggcccacgtcggtgatgttcatcacccggtggacatcatagccagtccagcggaggaacttctccagcacgtcctccatgatataactgcgcaggttgccgatgtgggcgaagtgatacactgtggggccgcaggtgtacatctccacgcggccgggggtgtgggtcttgaactcctctttcttgtgggtggccgaattgtacaggtacataaacactgctccttttacgtttccgaaccggcggattcctcccgccggctcttgagatattgttcatccatgagtttttccaaaaattccagacgggataaggctgcattcaacttttcctctacggggtcccggacgctgatctggtccacctcgtcggcgaaggtggcgatctttccggccactcggaccacatgggcggggacgcccacggcggtgcagtcctccggcaccgcgctgaggaccacggcgcccgcggcaatgcgggcgttgtcccccacggtgaaggggcccagtaccttggcgccggaacccaccatcacattgttgcccagggtggggtggcgcttgcccttgtccttgccggtgccccccagggtcaccccctggtagagcagacagtcgtctccgatctccgcagtctcgccgatgacaatgcccatgccgtggtcgatcaccagccggtggccgatggtggcgccggggtggatttcaatgccggtccagaaccggctccactgggagacgcaccgggccagaaagaatcgatgatgccggtacagccaatgggccacccggtggtacagaacggcatggacaccagggtacaggagaaaaatctcaagcttgctgcgggccgcggggtcgcggcgctggtaggcggccagcaggccgcccagtcgggttactcgttttgccatatcgaattgctccttgtgcggatcgggaggccatgaaaaacgcctcccgtaccaaggtacgagaggcgacggatcgcggttccactctcttttatcactcaaggaggcccgttgacgctggccagacggagggcttccacatcccccgcgctcccgggcgcacgttcacagctcccgccgcaggcgcgcttgcagccggtgacgcgccctctctgttctttggaagtgctgttactcttcccgatcaacacgctattccatttacgctttgtatcttaacaggatttgagagaggtgtcaagagacaacttcacgcaggaatatcccggccctgcgccctgcgccttgacagcgcacctgcttctccatacagaatatgccggaatgtggaaaccgtccccctgtcaacaggcggttgacaaaattccaatggctgtcgcttgccaagcgcccgccttttcggtatgatgggaccaaagaaaaggaggggatactccatggaattgaaggaccgtatcgctgccgtccgcaaagcggcgggattgacccaagagcagctgggcgagctgctgggtgtcacccggcaggccgtcagcaagtgggagagcggccagaccacgccggacgccgccaccatcgccgcgctgtgcgaaaagctccatgtgtcggccgactatgtgctgttgggaaaggagccgggggagggacagaccgccgcctatgagccgccggacacctgtccctgctgcgggcggaaggtctccggcagcatctgtccggaatgcggctatcagctgcccaatcatccgccccgtgggccccaatacgctgtcgttgccacccgccccggctttgtgcagagcacggagtcgtctgcccagctggtgaaatactgcggcttcacccaagaggatgccaacaatgccatcgcccactatgtgaacaaccagtcccgcatcctgctgcagcggggactggttgacagtgcggcccagtacattgccgcccatctggaccaggatttcttctgcccgcagatcgtagtggactgcggggaatccgaggaggcgctgctttacaaacccaaagccttcgagacaccgtctcccgtcaagagtcaagagggcatcggcttctggggcgtggtgggtgctgttatcgttgccctgctgatcctctcgttcttctgatgatggaccggtcctttctgcggcggtacgccgcctccggcgcggtcatcgccgggctgtatctcctgaaccgctttcttttggtccccctgaccagctgccgcctgctggcttggcacggggcggacttcctggccggcggcttgatgctgtgcctgctgaacggtctgctgtgtctcacccgccggcggccagtggagcgggccctgcctgcctcgcttttcctgctggcctgcggccttttctgggaagtggtcacgcctctgtacctgctccgatccgtgggcgacctccgggatgtcctggcggtgtggctggggggcgtggctctgctgtccctctggcgggtgtgggaccggctggggcctggaagctgaacatgtcaaaacgcccccggcgggagtgacccgccgggggctcgtctgttgtcagagtcacgccgaggcgatgacatccttgttcttcacgaaatactctacgccggagtacagggtggtgagggtgatgacccacacgcagagcgtgttcaccaccggtggaatgggcaggaacatcagcaccacgcacaccatagtggcggcagtcttgaccttgccggaccatccggcggcgatgacccgtcccttgtcgctggcgatcatccgcaggccgctgacggcgaactcccggcaaatgacaatgagcagcatccaggcgggcatctgcccgatctccacgaaccacagcatggcggcggtcaccagcatcttatccgccagggggtcggcaaacttgccgaagtccgtcaccaggttgtacttccgggcgatcttgccgtccagcatgtccgtgaggctggcgatgatgaagatggccagcgccacccacgtggcgccggggaagccccagtacagcaccaccatgaaaaccgggatcagaataatgcgcaaaagcgtcaatttattgggcaaattcatggatgtttactcctccgccaattctccggtcagttcgccgtccatgacgccggtaagccggacggtcacaaaggtgcccggttccacctcccggtccgcgtcaaaccagatgcggccgtcgatgtccggggactcggcgtagctgcggccgaagtgcatctgggcctggctgtcgaagccctcgcacagcacctcccgctccgttcccagaacagactcgttgtacgcgtcgatgatgtcggactgaacgtccaccaccagctccgcccggcggcgggcctcctccatgtccacatggtccatctgggccgcccgggtgccctcctccggggagaaggggaacaccccggcccgttcaatctttgtctcccggagaaagacacacagctcttccagctccgcctcgccctcgccgggcaggccggtgatgaggctggtccgcagcaccaggccggggatgcgggcccggagctttgtcagcaggtccagcagctccgccttggtatcccggcggttcatggccttcaggatcccgtcgttgcagtgctggatggggatgtccagatacttgacgatcttgggctcctccgcaatggtgtcgatcagctcctcagtgatctcgtccggatacagatagtggagccggacccagtggaagtccagcctgcacagctcccgcaggagagacgccagctggtgctcgccgttcaggtccgttccataccgggtgatatcctgggcgatgaccagcagctccttcacgccggcgtccgccagctccctggcctcttccagaaggccctccatggggcggctgcggtatttgccccgcagggaggggatcacacagtaggcgcagtggttgtcgcacccctcggcgatgcggaggtaggcataccaggggggcgtggacaggatgcgtcccccgtcctggggggcggtgtggatgctgcccaggtggcagggcctcaggccagaggcccccatcacctcgtcgatggcggcgcagatatcgccgtagctgccggtgcccagaatgccgtccacctccggcagctcgttcagaacgtcctgcttgtaccgctgggtcatgcagccggtgaccaggatcttctgtacctggccagcccgcttcagctccgccatctccagaatgttgtcgatggcctcctcgcaggcggactgcaggaagccgcaggtgttcaccaccaccacgtcggccccctccggctgggcctggatggtatggccggcggcctggacagaggccatcatctgctcgcagttcacctgattcttggcgcagcccagggagataaaggaaatgttatatggcacgatcgagtcctccaatcgatggattgttgcaaaatgggcccggcggggccggcatgtgtgtcccattggacagggaatgacagccatgatgtggctgggcagatacgcccacttgtaggagcaggcaccccataaccgccattcggcggcccgtatgcctccccggagggaatacccctgcgagacgggactcattcttcgagaatctccgctcccagacggctccatgcctcccggacgtctccccaagcaaacccccgccgcagcagtgcgctggtgagccgccgcttctccgcctcctctggggcccggccccggagcttggccgcaagaaatcggtcaatctgccaggcgctgtccggtgcctgatccagagcctcgtcccacagctcccggggtacgcctttctcccgcagtttctctcgaatgcgggccgggccataaccaaggccggcgcagtggcgcaccaagattgctgcgtaatctgcatcgttgatggcaccaatggcctccagccactcagcggcgtaccgcgcctccgcctgactggcccccttctcctggagcttccgctccaggtcgcggcggctcatggcccgcttgccgatgaggtccgccgccgtggccttcacgttggagacgctggcagccttcttcagctgctccagacgtctgccgtccaaatcatctccagtccgcaggccgaagtccagcgcctcctgctctgtgatcttcaggcaggcgccgtcctccaggaacaccagcacccggccctttttgtgggcagacgcctggacgcgctcaatccgcatcttcgaagtcgtcggcgctcacatccaccgcccggcctgccgccttggcggcgatgcgggactggttgctcatcagcttgtcgaagttccggcggatgtccgcctccagcttgtccgccgtctccgggttctcctggagataccgcttggcggcgtcccggccctggccgatgcgggtctccccgatggagaaccaggagccggacttctgcaccagctccagcttcacgcccaggtccagcagctcaccgaagtgggagattccctcgccgtacatgatgtcgaactccgcctcccggaaggggggcgccaccttgttcttcaccaccttggcacgggtccggttgcccacgatctcagaaccgtttttcagcgcctcgatccggcgcacatcgatgcggacggaggcgtagaacttcagcgcccggccgccggtggtcacctccgggttgccgtacatgatgcccaccttttcccgcagctggttgatgaagatgacgatgcagttggtcttgccgatggcgccggtgagcttccgcagggcctggctcatcagccgggcctgcaggcccacataactgtcgcccatttcgccctcgatctccgcccggggcaccagggccgccacggagtccaccaccaccacgtcaatggcgccggagcggaccagggcctcggtgatctccagcgcctgctcgccggtgtccggctgggcgatcagcatgtcctccacctggacgcccagtgcccgggcataggtggggtccagggcgtgctctgcgtccacaaaggccacctcgccgccccgcttctgggcctccgcgacgacgtgcagagccagggtggtcttgccggaggactccggcccgtagatctccacaatccgccccttgggcaggccgccgatgcccaaggccacgtccagggacagagagccggtggggatgtaatccacgttcagctccgccttgtcgccgaagcgcataatggcgcccttgccgtacatccgctcgatctgggccatggccgtgtcgatggcccgcttcttatcgtccgccggagccgcgttgggcagcggcgctttctctctcgccattgtattctcctcctgattctctataaaaactctttatttcaactcatctgtaagtcccttacttctctgagagagtccccagcagagggatccaaacagcatccctccatacacgatcaccgcgcggccgccaggcagcgtctcccggacagggtcccaatactcaggcgcataactggacgggcctgtttcaaccgctgcaaaaaggttaggtcaccgctgtggccgccatggaaagggctgacgccctatacgccgtataacgcggcttgggcgagtgcttaacgaaaccccggcgcatcagcgtccagcccgacaccaggggcccggcccacagcagggtcggacttcccgcctcctgcacataaaacggcagccccaccattgccgttcctttctctaaacgtcagagctctgtacacagcgttccgaataccacccgggggatgtcgtggtggtccttcaccacctggatatccccgaagccctgggtccgcatgatccgcagcacgttgtccgcttgaccgatgcccacttcaaaatacagacggccgccgggagccagggcctccttccacttctcggagatgctccggtagaagtccaggccgtcctcgccgccgtccagggccagatggggttcatagtccttgacggaggtgtccagcgtctcgatgtccgcccgggggatataggggggattggacacgatgcactggaactctcccagggatttctccggcttttcccgggcgtccgcctgcatgggcaccacccgggcggtaaggctgttgcggcggacgttctggcggcagatcttcagggccccgtcagaccactcccccagcaccacccgggcctggggcacttgggccgccaccgccagcccgatgcagccgctgccggcgcacaggtccagcacccggcattcccccaaggtcttgatatagccaatggcctgctccgccagcacctccgtgtccggccggggaatcagcacgtcccgggagatgtccagcgggagcccatagaactcccactcaccgataaggtatgccaccggctcgccctccagatgccgccgcaccaagtcccggacccggtgctccagctccggggaggcgtacagtcccccatcccgggccagctcctcccggctcttgttagtgccgaagcaaaccaactcccgggcctccagcgtggcctcctcgatccctgccctccgcagctgctggcggatatccaaatacaaattgttgtatgtcgtcgccataatacgcctcattatcaaaaattcaccattcgtctttccctttttcactgggcaagaccagctccagggaccggatggcgcactcgatcatggagtcgtccggctcattggtggtgaagttctgcatccacattccgggggccgtcaggattttggccagccgactgtcctgcacgtggcggcccacccagcggttgaactcataggtaatgcccaccaccagaggcagcagaatcagatgtgccagtgtccgcagccagacattggtgatgggccagatgccgaacaccacactggacaccaggatggacacaaagatcaccacgaacagaaagctggtgccgcaccggggatggtgccggggctgaatgcggacgttctccaccgtcaggggcagccccgcctcgtagcagaagatggtcttgtgctccgccccgtggtactggaacacccggtagatgtccttctgcttggagcagaagatcagatacagtaggaagatagccaccttcagcacgccttcgatcaggttccggccccacatggggaagtccgggaagaagtgcagcagcccgccggtgaggaaggtgggcagcaccagaaagaggaagatggacaggccgatacccagcagcacagagaggcccacgatcagcccctccagcttcttgttggaaaaggtccggtccagccactgttcaaatttggagggctccgtggtctcctcctccggatagaagtccgcggagtacatcagcgccttcacgccgttgaccatggaggagaggaagttgacggtgcctcggatcaggggccagcctaaaataggatgccggtccttgatgagccgcagctcctccaccttctctaccagattgccctcctggtcccggaccacgatggcctgcttctccgggccccgcatcagaatgccttcaatgagtgcctgtccgccgatgctggtgcggaaggcgcaggattggggttgttttgccatgtgtttcctttctaattccgtacagttgaattctaccatgctctgtgcagaaacgcaaacatttgttcgattttcggaaatcattccttgaccggcaggcagatggtgaccaccgcgccgccgccatcggcgttgccgatggtgaagatgccgttgtgaaggccgacgatctcatcgcacaccgcaaggccgatgccgctgccccgggccttggaggagcccttgtagaacttctgcttgatgaagggcagctccgcttccgggatgccgggaccgtagtcccggacccgaaccacctcaaactcgccctcccgactgatggaagtgtcgatccgcttgccggagccgccgtgcttggcggcgttgtccagcacgttgcagaacacctgcttcagccgctcagagtcgccggggatgggaggcaggtcctcatccccgcactcgtagttcagtttgatgccctcctgccggaacagctcgccgtaggtgaagatggcgtcctcaaactccgcctgcaggtccacctgctccatccggagggtgaatcggccgtcctccatcttggagaattccagcagctcctctaccatggtagagagccgccgggcctcgttcagaatgatgcggatgccgcggcgcatctgggcggggtcatctgtggtgtcctccagaatcgtctcgccccagccgttgatggcagtgaggggcgtccgcagctcgtgggacacggaggagatgaactcggatttcatcttctcgttctggccgatcttgagggacatatcgttgatgttgtccaccagttcccccagctcgtccgtgtacttgttttcgatctggaagccatagctcccggcagagatccgcttggccgcctcagacaccacggccaccggctccaccacgttgttgatgaacagcaggctggagatcagcaccagggccatgcagatgcctcccaccgccagaatgataaagaccaccaggacaatctgccggtccaccagcttcatggacgtcaccagccgcatgacgcccgccacccggccgttgaacaacaggggcgctgagaccgccatgatcttctcacccgtctccgggtctctgccttggaagggcgtgatctcctgattggtgatggctctggtaatatcgctggtacccggcgagctgcctgctgtcaggccggaggtggacatctggatacgtccggtgctgccgatgaactgcagctcaatccgggacttgtcctcataggtgtccactgcctgggtcgccatctggttgtactcggagtagctgttcatgaagtagtcgttgaaagcactggacatggcctccgcctgcttcatcaggccgttttccatgctgctgtaatagtaggtggaaacgcccacagataccagcgtcaccagcagcatcagcagcaccagcaccggcagaatggtattgacgatccaccgcttccgcaggccccggaggcgcagcaccgtccatttccgatcccgttcttcctctgccatgggccgctcctcctttccctgcgttccttacgccggcatcactggccggccgattttctcagaacccccacttgtatccgtatccccacaccgtggtgatatacgtgggattctgcacgttgcttcccatcccgcggcgcgggatgggacccctttcctcagcttgcgcggcggaagtaaattccaccttgcgccaaggttttggcttccgccaaaacgcttgtacgggccatcggcccgccccgctccgcggggccccggacaacgcccggagccgctcagaacccccacttgtatccgtatccccacaccgtggtgatgtacgtgggattctgcacgttgcttcccatcccgcggcgcgggatgggacccctttcctcagcttgcgcggcggaagtaaattccaccttgcgccaaggttttggcttccgccaaaacgcttgtacgggccatcggcccgccccgctccgcggggccccggacaacgcccggagccgctcagaacccccacttgtatccgtatccccacaccgtggtgatgtacgtgggattctgcacgttgcttcccatcccgcggcgcgggatgggacccctttcctcagcttgcgcggcggaagtaaattccaccttgcgccaaggttttggcttccgccaaaacgcttgtacgggccatcggcccgccccgctccgcggggccccggacaacgcccggagccgctcagaacccccacttgtatccgtatccccacaccgtggtgatgtacgtgggattctgcacgttgtcctcgatcttcagccgcaggcggcggatgttgacatccacgatcttcagctcaccgaagtagtcccggccccagaccatatccaggatctcctcccgggagagggccttgcccggattttccatgaacaccttcatgatggaatactccacctgggtcagcttgattcgctggccgttcttctccagcgtccggttgcgggtgttcagcaggaagggatcctgccgaatctccccggtctgggggatctcctctccgccggcccggcggaacagggcgtccacacgggcggtaagctctgccggggagaagggcttggtcacatagtcgtcggcgccggtcatcagtcccgtcaccttgtccatctcctgggaacgggcggtgagcatgatgataccgattttggtgttggtggcccggatgcggcggcagacctcaaaaccgtcgatccccggcagcatgatgtccagcagcgccacccgggtatcggggttctccttcagcttgtccagtgcctcttcgccggtctccgcctcaatgacgtcgtacccggcacggcgcaggttgatgacgataaagctgcggatgctggactcatcctccagcaccattacttttttcattcggcataccgtcctttcttctctgtcagctgtcgccggcggaccactccgtggtgatcaggctgaacgcctcccgcacctcgtcttccgtcaggccgtattcccagctcccatttgcgtccagaagctcggccgtgtagatgatctccggcagacggcgcaggatgacccggccgccccgggtagctctggcctcgcggccggagcctgtgagcttggtgatccgcaggacatcctgtggtggctccccgctgtctccccggtaagagaatgtgaccgtgacctcctccgtcccggccgtgcgggtaatgaggatctgatccttccacacgtccggcaggcgcaggtaccagccgtcctccacactgtggtaggtgctcaccacagccgctttggtgccgtcgctggtataggtataccagtcgatccgccggcaggggtcctcacccacgtttccccaggccgggatcggctcgggatgggggacctctgtgataccgtcgccgttgatatcctccgggtacagggaactgaagggcgcgatctccgaagacacccccgtcacgtcggacagcaggatgttcaccagttctccatttttcacggtcaggatgtcagtgaccatccaggccgactcctccacccccgtgacgaacagggccggcgtaccgtcctgtaggacaccgctcttcacacgcccctgctggctcagctccgccatggtgctggtgatccgtgcggaggttcgcagctggaactcttcctcctgccagcagtagtaatccgcaatgccgttgccctcctcatcggcccggagcaccaccagctcccacaggccatcctgattcagatcgttgaccgcatatttcacatagctggtgccctgcaccagctcctccggctccccggaccgcagggtgtagacggagagggccaggaggtccgtattgacccgccagcccaccagcagctccttccggccgtcctggtccagatcctcgtaggcaatgctgtaaatgctggtgccggtgccctcaatgacggcagcctgctcatatccctgctttccggcggtaaagatatagatcttcaggggcttctcatccgcagagttgcggaagaaggccagcgcctcctcctcgccgtctccgtccagatcctccagctgcacgggctggatgttgctgccggagacgggggccgcgtactccgccccgctctccagcagctggttgagtgagctgttcagctccgtgtactcctccggcagctgcggcaggctgtacaggtccgtgggggaaaaggaaaatccgcagccgctggcggacagaagcagaagcaggccgaccgctgccgtcagcatccgctgtattcgctgtctcatggcctcctcctctctgccggtgggctgcccccgccgaaaaacgcataattcaacttatatatgatagcacgttttctccctgatgtgtaggggttgtcagcatttttcccgcattttacgttctgttcatttttccgccgtccccggtcggaaggccgcgatcagggccagcttccgcctgcgatccagccgtttgatggcggcctcccgccgcagggccgcagaccggtccggcaccgcctcctggtagaccagctccaccggcaggcggctgcgggtgtacttggcgccccgcccgctttggtgggcctggaggcggcggggcaggtcgttggtgcagcctgtgtacagtgtgccgtccccgcagcgcaggatgtagaccagatagcccataccgtccctcctctgtccgatgagaccagtataccacagcccgccgccccgtcaaagggctttccgcatggggacttccctgcccggcataggaatgatggtacagggagggattctatgttgtctgccgcactgctgctcttcgccaacacgctgctcttctcactccgcctgtccggcggcgggtcgtttccaaagccgctgtccgccgcagaggagcgggaatatctccgccgctacgcccagggagatcaggaggcccgggatgtactcatcgagcggaacctgcgcctggtggcccacatcatcaagaaatactatacccagagcgccgatcaggaggacctgatctccatcggcaccatcggcctcatcaagggcatctccagcttcgacccggagaagggcgcccgcctggccacctacgccgcccgctgcattgaaaacgaaattctcatgtacttccgcagccagaaaaagctccagggagaagtctctctgtcggattccattgagacagacaaggagggcaatgccctccagctgatggatgtggtgggcgtggatgacaccatgctggacgatatccacgaccgggacagcgcgctccggctccaccagatcatccgggagcgtctgaccacccgggaggcggagatcattcgcctgcggtacgggctgggcggcaccatccccctgacccagagggaaattgccgcctccttcgggatttcccggtcctatgtatcccgcatcgaaaagcgggcgctggaaaagctgcgccaggagctgcaggacggccctgcgccccagctggtccggcggaggccccattcctccgggacgtgaccgccggatttggaaaacagagggcgtgatggaaaatttccatcacgccctttctttgcgcgcttccgcgcctttcaatagcgccgcaccacggcggccaccttgcccaatatctgggcataggtgccgtcaatgggggaatatgcctcattctccggcagcagccatacctgaccgcttttcagagacaggcgcttaaccgtcgcctcgtcatcgatcagagccaccacaatctcaccgtgctgcgcagtgggctggctgtgaaccaccaccaggtcgccgggcaggatgcctgcgttcagcatggactcgccccggacccgcagggcaaaatactccccgggccgaccggcggtatcgaaggtcaaatagtcctcgatacactcctccgccagaatggggctgccggccgccacattgcccaccactgggacctgattttcaggcttaggagattcccgcagcgtgatggcgcggcccttgccggcgcccttttcaatgacgcctgcctcctcaagccgtttgaggtgaaaatggactgtggagggtgacttcagccccacggcctccccgatctcccgcaccgagggggggtagccctgctcccggatacaggcggcaatgtactcgtagattttctgctgcatctttgagagctcccgcatacgtgtccacctccgctggatttctggctgtattataccacaacgccgcaggaaaagcaaacatttgttccatcattttcaaacttttttgtcgtctgtccgtacgcttccgcatagctttgatttgtctgcttttttgcaaaatccccttgaaatacagagaaaactatggtatcattaacatctgtgaaatcatgatccatgcgctgcatggctgaaagttttggaggttatcctgtatggacgctttaacgctcgtcatcacgatcctgcagcttctctgcggtctggcagtcattgtcatcgtgctcttccagtccggcaagagcgccggcctctccggtgccatcggcggtgtggccgactccttcctgtcccgcaacaaggccaagactctggacgccaagctggcccgcgccaccaaatgggttggggccatcttcctgatcctgacgctggtcctgctgatcctgcagggctgatttcgcgctgaaagcgcccggtgtgccagcacaccgggcgcttttttatatgtcgccggagcagtacagcacaccggcctccggttggataccgttggcttccagcagttcctgcaccgtcacgaagcggtagccttccccttgaagcgtatctacaatctccagtgccgcgtccacagaggtatcgtagatatcatggagcaggatgatctgattgggggccgcattttccaggaccgccgccttcacctgggctgtattgagcttttcccagtccctgggatcgatggaccactttatcatgggcacctgcagcagctcccggtccgccgcatccacggccccgtatggcgggcggagccaatatggcccccctcccagcaacgcttccagcgtctcctctgtacggcctacctcccgctgcagcgtctcccgggagatcccctgaagccgtacatggttccaggtgtggctgcccacctgatggccctctgcctgcatccgccggaccaggtcctcattgccttcgatctgcttgccaatcaggaaaaaggtggcgcttgccccccgctcctgcaggccgtccagtagccgctcggtagtgttccggcgtgggccgtcgtcaaatgtaatggcgatcagcttgtccgccgggagctgggcatctgccccagcctccgccacagggccgcccggcgcgcagccggacagcagtgccagggcaaggcacagaaaaaacaggcgacctctccacatcgcgcccacacctcctcattcatgcagcggtagtttgcgcggcagctgaaaatttacacccgttaaaattttctcctgttttttcataacacgaaaaaaggaagcgggccccgcccgcttccttcatctcatattccgttcggtgctctgcatagacggtcaggagaacaggtcagaaatggcatctcccaccaggtccactgccagatctgacaccacttccagtcccagaagcactcccccctccttggcagctgaatgggctctctttcgcccgcgtgctgcgggcttctccctctgctgaaattccggtttcttctcgagctgcggcgcgtctccgtcccctgcaggctgattgaaggccccgcaccgggggcagaagccgtctgcatcgcaatcataccgtttgccgcacgaagcgcaggaaatcttcttcacagatgttccctcctttgctctgctgccgggcgctcacaagtccccgccgggcagccgtcgaccgtgggactgctccttcagcagccggcccatggccatctctgcctgacggagattttctcccagttcccgctggagcctccctgtccgcttctgctgtgccgcaggggactcagcggccgcggcggtcccgccgctccggacccagacaggctggttgaaggccccgcaccgggggcagaagccatccacatcgtagtcataccgctttccgcagtcctcacagtgaaccatgcgcatagagatctcccccttcgcttccattgtatcacatctccttcaggtccacaagaacaatcaaaagccctttgtcacaggtcctaggttcccatgacaaagggcttttttgattgcgggttcttacttcaccagctcgatgatggcggtctccgcggcatctccgcggcgcacgccggtgcggatcacgcgggtgtagccgccgttgcgctctgcatagctgggagcgatctccttgaacagcttcttgcagacatcctcgcgggtgatgaagctcatagcctgccgataagcggccaggtcgctcttcttgccgagggtaatcatcttctcagccagaggcttgatctccttggcgcgggcaagagtggtctccatcttgccgttgtccaggaaatccgtcacctgctgacgcagcatcgccatgcgctggtcagtgggcttgccaagtttccgagttccgggcattttggtttcctccttatcaggattttggtcagccggggaacgtccgccggcattggaatcagttgttgttatcttcgtcagccagatggagtcccatcatcgccagcttgttgatgacctcttccagggacttgcggcccaggttgcggaccttcatcatctcgtcctccgtcttggaaatcaaatcctccacggtgttgatgttggcacgcttgaggcagttgaagctgcggacggagagatccagctcttcgatggtcagctccagcaccttgtcccgctgggcctccgccttctccactacggtgggcttgctgcccacgttctcagagaggtcggtaaacagcgtgaagtggtcgcacaggatcttcgcacccaaggacacggcgtcccgggcagagatggtcccgtcggtccagacctccagcgtcagcttgtcgaagtcgctggaagcacccacacgggtgggctccacggtgtagttgaccttatacacgggggtgtagatggagtccacggcgatgacgccgatcacgttctgctgcggcttgttgcggtccgcaggcacatagccgcgtccgtgggacagggtgatctccatgttcagcgtcgcgccgttgtccagcgtggcaatgtgcatgtcgggattcaggacctccacctcgccgtcggccttgatatcgccggccttgacctcgcaggggcccaccgcctcgatgtagaccgtcttcaccgtctcgcagtggagcttggtgagcaggcccttcacattcaggacgatctccgtcacgtcttccttgacacctgggatggtggagaactcatgctgcacgccggcgatcttgatggtggtcggggccgtgccgggcagagaggaaagcataatgcggcgaagcgcattgcccaaagtggtgccgtagccgcgctccagcggttccaccacatacttgccgtatgtggcgtcccccggcgtctcgatgcactcaatctggggcttttcaatttcgatcatgcagtagtaccctccttcatcttcttgttgcgagcacgcatgattgcgcgccgccggcagttcctatcattattgagggtatcctccgcttacttggagtacaactcaacgatgaggtgctcctcgacgggaacgtcgatgtcctcccgggcgggcagacgggtcacggtgcccttcagggcgttcttctcacgctccatccaggcggggatcaggaacacgggggcatcctggcccagcaggcgcttgaagatctcagaggagcggctggactcggcaacctcgatcacatcgccggccttgacctgataggacggaatgtcgaccttccggccgttgacggtgaagtgggcgtggctcaccagctgacgggcctgacggcgggtcatggcgaagcccatgcggtataccacgttgtccagacggcgctccacagcgatcagcaggttgtcgccggtcttgccgggggtcttggcggccgcctcgtaataggcgtggaactgcttctccagaatgccatagatgaacttgaccttctgcttctcattcagctggatgccatattcgctcttcttctttctcatctggccgccggggttgcgattggtctccttcttcgcatagcccatcacggcaggagaaatgcccagagccttgcagcgcttcgcgatcggctgcatattcttagccatttgcttgttacctcctcttcaaatcagacacggcggcgcttgggggggcggcagccattgtgggggatgggcgtgacgtccttgatcatggtcacttccaggcccacggcctgcagcgcccggatcgcggcctcacggccctggccggggcccttgacgaagacctcgacggtcttcaggccatgctccatagcggcgcgggcggccgtctcagccgcggtctgtgccgcgaagggggtggacttcttgctgccgcggaaaccgaggccgccggaggaagcccaggagatcgcgttgccctgtgtatcggtaacagttaccatggtgttgttgaacgaagagcggatatggacctggccccgctcaatgttcttccgttcacgccggcggcgaatgaccttcttgccggcggatgcctttgcagttgccatcttggttctccctccttacttcttcttgttggcaatggtcttcttgggacctttgcgggtccgcgcattggtcttgctgcgctggccgcgcacgggcagacccttgcggtggcgaatgccgcgatagcagccgatctcggtcagccgcttgatgtccagagcggtctggcggcgcaggtcgccctcaacggtatagctgtcgatggcgtcgcgcagcttctgctcgtcggcgtcggacagatccttcacgcgggtgtcggggttgacgcctgtctgcgccaggatgtccttggcgctctttctgccaatgccgtagatataagtgaggccgatctcgatacgcttatccttcggcaggtcaataccggcaatacgtgccatactctcaaagcacctccaattaaatgttagccctgtctctgcttatgcttggggttctcgcaaatgaccatgacacggcctttgcggcgaatgaccttgcacttctcgcacatgggctttacggacggtcttactttcatagtttttaaccattcctttcagcggtttgtgtcttttcagctcaagtggcgcttacttactgcgccaggtgatccggccgcgggtcaggtcatacggggacatctccaccgtcaccttgtcgccgggcagaatcctgatgaaattcattctgagttttccggaaatatgtgccaaaatcttgtgtccatttccaatgtctacctggaacgttgtgttgggcagggcttccaccacgacaccctccacttcaatcatgtcggattttgccaaacgttatccctcctggtccggataaacctcctcgcggtaagccgcaagggttttgcgaagctcgctgttggtgatcctggcttcgcctctgatcttttcagaaagccggttctcgtccgccgctacaaacagcacgtgtctgcgctttttgcgtttgggcgactccaccttcctggatttcccgtccgccagcagcaggtactccccctccaccgcgagaacgatgaagagctttccctggtcccggccggcaacggatcttacgatgttggatgctgcaatttccatgcgtttcctctcagatggcgggggccgtcaggatctcaggctcgccgtccgtgatcagaatggaattttcatagtgggccgcccatttgccgtccagcgtcttgacggtccagccgtcgctcatctgctggatggccgccgagccggcgttcaccatgggttcgattgcaagcgtcatgccgcggaggagcctgggcccccggccgggatggccgtaattggggatctccggcgactcgtgcatctgggcgccgacaccgtggccgacgtattcccggacgatggagtagtcgtgactctccacgtactgctggatggctgccgagatatcgaacagccggtagccctccttggcaaacctgattccctcaaaaaagctctgtctggtcacgtcgatcagatcctgcgcctccggggagatcctgccgcaggggaaggtggccgcacagtcgccgtgaaaccctccaatgtacgctcccacatccacactgacgatatcgccctcctggaggacccggggtccgggaattccgtggatgatctcgtcgttgacgctgatgcaggcgctggccggatagccgttgtaatgcaggaaggaggggactgcgccttgcttgcgaatgaaatgctccactgcacggtcgatctcatgggttgtgacgccgggctttaccaattcccctgcataagcacgggcagccgcggtaatttttccggcccggcgcatcaattcgatctcatggggggatttgagtgtaatcatacgctcatctccccagtgcgtggaggatggcccgggaggtctcttccacagagggctgattctccacaggcttcaggagtccccgctgggcatagaagtccttcagcggctcggtctccttatgatagacctcgagccgcgccttgacggtctcgggggcatcatctttccgctggaccagcttaccgccgcacttgtcgcacacgccctcctgcttggggggcacagctaccatgtggtagctggccccgcaggattcgcagacacggcggccgctcatccgctccatgatggtctcgtcagagatctcaatagagatcacgtcgtcaaatgtgatcccggccttttccagggccgcggcctgggcgatggtgcggggcaccccgtccaggatatagccgttcttgcagtcatcctctgccagccgctccgtgacgatgccgatgatgacgtcgtccggcaccagctggccggcgtccatataggacttggccttcaggccggtgggcgtgccgtttttgatggccgcccggaggatgttgcctgtggaaatggtgggaatactcagttctctgcacaggatttccgcctgtgttcccttaccggcgccgggggcgcccaacaggatcagcttcaattgaaacgccttctctcttattccaggaagcccttgtactgacgcatcagcatctgggcctccagcgccttgacagtctccagagccacgccgaccacgatgatgacggaggtgccgccgatcgccagataagcgttgccgacagccttacccagcagcagcgggcagatcgccacgatgcccagataaatggcgccgaacagggtgatcttgctcaggactttcttgatgaagtccacagtgggcttgccgggacggaatcccgggataaagccgccctgcttcttcaggttgttggcgatctccaccggattgaactggatggtggagtagaaatagctgaaaccgatgatcatgatgaaatacacgatcatatagatgaaggactgggtatcgatggcgtcgtagattgcccgggaaaccgtctcctcctcgggaataccgatgaaggtccagatcgtcacgggcagagacgcgatgctctgggcgaagatgatgggcagaacgccggacatattcaccttcatggggaggtgagagctctggccgccgtacatcttccggcccacctgccgcttggcatactggacgggaatgcggcgctctgcgtcgctgatgaacacgacgaacacaaccagcgccaggacgcccaccagcagcaacaccaccagagccgggtgcagcgcaccgtccgcggcagcgccgccgttggcccagctcaccacgccgctgtacagagagctgacagaggtggggatccgggacaggatgccggcgaacagaatgatggaaatgccgttgccgatgccgaactccgtcacctgctcgcccatccacatgacgaaggaggagccggcgatgaaggacacgacgatgaccagtgcgggccagatgccggtggcatcagatgccagcaggttgtagttgcgcatcatgaaatagtagccgaccgcctgcaggatggcgatgccgacagtggtatagcgggtgatggactggatcttcttccgtccctcttcaccgccatccttggccagccgctccagggccgggatggccacagtcagcagctggatgatgatggatgcgttgatatagggctggatgctcagggcgaagaccgttgcctgggcaaaggcgccgccggacatcacgttgtacaggcccagaatggtgccgcccatctgatccagataggtctccagcaggccgacatccacgtaaggcaccgtgatggcgttgccgatccggaagatcaacaggatgaggagtgtaaaaatgatcttcttccgcagttcggggatgccccacgctttgcgaatggtttggatcacgttacatcacctcggcctttccgcctgctgcctcgatagcctccttggcagaagcggagaaagcagaagcctggacagtgagcttcttggacagcttgccgctgcccagaaccttgtagccgtagcggcacttggagaggatacccttctccagcagcgcgtggaccgtgacagtatcgccgtcctggaactgatccagggtgctgagattcacgatctccaggggctttgcgaagatgttgttgaagccgcgcttggggatgcggcgggccagaggcatctggccgccttcaaagccaacacggatcttgccgccggagcgggccttctggcccttgtgaccgcggccgccggtctttccgttgccggagccggcgccccggcccttccggtacggggcccggacggagccctcggcgggagacagttcgctcaacttcataattccgtgcctccttatttcacttctgtgacctgcagcaggtagccgatcttggcgatcttgccgcgggtctggtcgttgtcgggctgcacggtgatgtcaccgatcttgcgcaggcccatggaatgagcggtggcgacctgtttttccaggcggccgttcaggctcttgacgagcttaatatttaagtttgccatttttgcgcctccttaacccacgatctcttcgacgctcttgccgcggatgcgggcgacctcctcgggaccgcgcatgctcttgaggccctcgaaggcggcggcgacaacgttgttggggttgttggaacgcaggcacttggtccggatatccttgatgcctgcggcctcgacgacggcacgcacagcgccgccggcgatcacgccggtaccgggggcagcgggcttcatcagcacgcggccggcaccggcctcaccgatggtctcatggggcacagtggtgccggagagggtcacggtgatcatgttcttcttggcggcttcgatgcccttgcggatggcctcggggacctcagcggccttgcccaggccatagcccaccttgcccttgccgtcgcccacgacgaccaaggcggagaatttcatcacacggccgcccttgacggtcttggagacgcggttcagggaaacgaccttctcgatatactcgctctgttctctttcaaatctaggcatgttgtcgttcctcctcccttagaatttcaggccgccctcgcgggcaccctcagccagagccttcacgcggccgtggtacagatagccgccgcggtcaaacacgacagtctcgatacccttggccttggcgcgctcggccaccagcttgccaacggcagtggcagcggcgatattgccgccgtaaccttcgatggccttgtccagggaggaagcggaagccagggtcacgccgttgacatcatcgatgacctgggcgtagatgttggcctcgctgcggaacacattcagacgcggcatctcaggggtgccggagatcttggcgcgcactctcttgtggcgcttcaggcgctgggcgttggtattcggtctcttaatcatatcggcacacctccttacttcttggcgccggtcttaccgaccttgcggcggatgacttcatcggcgtacttgatgcccttgcccttataaggctcgggaggacgcttctcgcggacctcggccgcaaactggccgacagcctgcttgtcgcatccgttgatgacgattttattgggagcggggacatcgatggtgatgccctcgatctcagaaacgatcacctggtgagagaagcccaggttcatgaccaggttcttaccctccttggccacacggtagccgacgccgttaacctccagctccttcttgtagccgtcggtcacaccgacgatcatgttatggagcagagtgcgggtcaggccgtggaggctgcggtgcagcttgtcgtcggaaggacgctccacggtgatcgtgctgccttcctgtttaagaatcatctcagggcgcagagccttcgtcagctcgcccttgggtcccttaacggtcaccacattaccctcggcgacattgacggtgacgccggcgggaacggtaatgggcattctgccaattctagacatggtccaataccctccttaccaaacgaatgccaggacctcgccgccgacatggagctcgcgggccttcttgtcggtcatgacgcccttggacgtagagatgatagcgatgcccaggccgcggagcacgcggggcagctcgtcggcgcccacatagacgcgcaggccgggcttggagacgcggcgcaggccggtgataaccttttccttgcccgcgttgtacttcagggagatgtggatgacaccctgggttccgtcctccaccacctggaagttcttgatatagccctcatccagcagaatctgagcgatgctcttcttcatgttggaggcgggaacatcaacggtgtcgtgcttggcgttgttggcgttgcggatgcgggtcagcatatccgcaaccggatcggtgatatgcataataaatcctcctattttagagttgcggctctctcgagaccgctgcggcagcgaggtatcatggcgaatggagcagtccgctcgcgcgtggtgcccaattcgtcatgacctttcgccatccgatctgccaaaggctccatatcaaaagcccgtggtcacaaaatttggttgcgcggggcgcctctcagaaggaggccttccgcacgccggggatctcgcccttgtaggccagttcccggaagcagatacggcagacgccgtagtcacgcagataggcgtgggggcggccgcacagcttgcagcggttgtatctccgggaggagaacttgggagcccgctgctgcttgagaatcatggatttctttgccatcgtttcttcctccttagcgggcgaagggagcgccgacctgctccagcagggcgcgggcctcttcatcggtgtgcgcggtggtgcagatgaccacatccatgccgcggatcttgtcgatcttgtcgtactcgatctcggggaagatcagctgctccttgatgcccagggcatagttgccgcggccgtcgaaggagttggggttgatgccctggaaatcacggacgcggggcagggccacgttgaacaggcggtccaggaactcccacatcttgtcgccccgcagggtgaccttggcgccgatgggcatatcctcacgcagcttgaagtttgcgatggacttgcgggcccgggtaatgacgggcttctggccggtaatctggctcagatcgcccaccacgttctccagaaccttggagttttcacgcgcctcaccgcagcccacgttcacgaccaccttgtcgatcttggggatctgcatgacgctcttgtagccgaactgcttcatcagggcgggagcgacttcggcagtgtatttttctttcagtctggccatttgtcagctctcctttctcacagctcagcgccgcagtgcttgcacacgcgggtcttcttgccgccctcgatcttgtgggcgacgcgggtgcccttgctgcacttggggcacaccacctgcaccttgcaggcggcaatggcggcctcgcgcttcatgatgccgccctcttcgccctgcttgcggggcttgacgtggcaggtcaccatgttgatgccctccacgacaaccttcagggagccgggaacggtgcccagcaccttgccctgcttgcccttgtccttgccggacaggacgacaacggtatcgcccttcttaatgttcatagccatttcgctgccctcctcaaatcacttcgggagcgagggacaggatcttcatgtaatccttgtcgcgcagctcacgagcaaccggcccgaagatacgggtgcctctggggttcttgtcatccttgatcaggacggcggcattgtcgtcgaaacggacataggtgccgtccgcccggcggacgcccttggcgctgcggacgatcacggccttgacaacctcgcccttcttcaccgtgccgccgggggtggacttgcggacggacgcgacgatcacatcgccgatgttgccgaacttccgcttggagccgcccaggacacggatgcacttgatctccttggcgccggtattatcggccaccttcagaaatgtttcctgctgaatcataacggcacctccttacttcgctttttcaatgatctcgaccacgcgccaccgcttgtccttggacagggggcgggtctccatcactttgacccggtcgccgatgccgcaggcattctcctcgtcatgggccttcagcttgtaagtgcggccgacgatcttcttgtacaggggatgggccacacggtcttcaatggcgacgaccacggtcttgtccatcttgtcggatacgactctgccgacccgggtcttgcgggaggaagttctcttctcttcgttcatgttcgattccctccttcttactgcttgtcagaagctccggagagctccttttgacgcaacatggtcttgactcgggcaatgtcatgcttggtctcccggatcttcaggggattatccagctgattggtggcgtgctgcatacgcagatagaaaagatccttcttcaggcccaccagcttctcgttgagctgctcgggggtcatgctacgaatttcacttgccttcatcttcactcacctgcttcctcggtgcgggcgacgatcttcgtcttgatgggcagcttgtggctggccagacgaagcgcctcgcgggcaacttcttcagacacgccggcgatctcgaacatgatgcggccgggcttcacgacggcaacccagaactcgggggaacccttaccggaacccatgcgggtctcagcgggcttcttggtcacgggcttgtcggggaaaatcttgatccaaacctgaccgccacgcttggtgtagcgggtcatggcgatacgggccgcctcgatctgattgctggtgatccaggcgggctccagggcctgcaggccgaactcaccgtaggcaatggtgttgccgcgggtggccttgccggtcatacggccgcggtgtacgcggcgatacttgactctcttcggcagaagcattactgggctcctccttccttagcgggtgccgcaggcgccgcgggggcagccggacggctgggattggtggcacggttgaaaccgccctgggggcggccctggccgcggttgaaaccgccctgacggtcacggttaaacccgccgccctggcgccggtcgccgaaaccgccgcggcggtcgccatcccggcggggacgacgctcacgacgctcctggtagggcttggaggtgtccatggtgcggggggtggtgcgcagggtctgagagaggacctctcccttgtagatccagaccttcacgccgatgcggccgaaggtggtggcagcctccgcgaagccgtactcaatgtcggcgcggatggtctgcagggggatggtgccctcgtgatagtgctccacgccggcgatctcacgtccgcccagacggccggagcagcaaaccttgatgcccttggcgccggcgcgcatggcgcgggccatggcgttcttcatggcgcggcggtgagagatacgcttctccaactgctgggcgatgttctccgccaccagctgggcgttcatgtcggggttgcggacctcgacgatgttcaggcgcaccttcttgccgatcagcttctccacagcgagacgatactgctcgatctgctcgccgcccttgccgatgaccatgcccggccgggcgcagtggaggaagatggtgacgacttcgttgctccgctcgatctcgatcttgggaacaccggcgccgtacagggtcttcttcaggtacttgcggatcttctgatcctcgacgatcagatcgccgaccttctcatcactggcataccaacgggaatcccagtctttgatgacgcccacgcgcaggccgtggggatttactttctgtcccataaaactgttctcctccctcttatgccttttccgtcacagccagggtgacgtgagaagtcttcttattgatccgataggcgcggccctgagcccggggcatcatccgcttcaggatggggccgggagtggcgaacacctcggacaccaccagcttggcggggtccatgccgaagttgttctcggcattggcacaggcggacttcaggagcttcatcagaggctcggaagcggccttgggggtctgcatcaggatcgccatggcggtgccggcgtccttgccgcggatcagatcacacacgatctggaccttgcggggagcgatgcggacatagcgcagatacgctttggcaatcttcatctcttccatgttctgcatcctccttcattaagaatctttccgatggccgcggaaggtgcgggtgggcgcgaactcacccagcttgtggccgaccatatcctcctggatatagacgggcacgtgcttgcggccgtcgtgaacggcaatggtgtggcccacgaaggcggggaagatggtagagctccggctccaggtcttgaggaccttcttctcgttcttcgcgttcatttcctcgacccgcttcagaagctccggggcaacatacgggccttttttaatggatctgctcatattgacttgcctccttacttctcgttgcggcgcttgacgatgaatttattggtggggttcttgcccttgcgggtcttgtaacccatggcgggcttgccccagggggtcaccgggccgggacggccgacgggtgcgcggccctcgccgccgccgtgggggtggtcattggggttcatgacggagccgcgcacggtgggacgccagcccatgtgacgcttgcggccggccttgccgatgttgatgttctcgtgctcgatgttgccaacctgaccgatggtggcgtagcagttggtgcgcacgatgcggacctcgccggaaggcagacggatctgggcgtcgccgccctccttggccatcagctgagcggcggtgccggcggagcgcaccagctgggcgccgttgccgggatgcagctcgatgttatggatcacggtaccaacggggatgttggcgatgggcagggcgttgccgggcagaatgtccgcctcggggccggtcatgatcttgtggccggccttcaggcccaggggcgccaggatatagcgcttctcgccgtcctcatactggatcagagcgatgttggcgctgcggttgggatcgtactccaggcgcagcacggtggcggagccgatcttgtcccgcttgaagtcaatgatacggtacttgcgcttgttgccgccgccgcggtggcggacggtgatgcggccgtagctgttgcggccggagctcttcttcaggggctcagtcaggctgggctcgggcttcgccttcttgtcgatgccgtcgaacccggagaccgtcatctgccgtctggagggagtcgtcggcttaaaagttttgatagacatgtcgcgttacactccttccgtttatcagaccataccttcgaagaactcgatggtcttggaatccgccgccagctggacataggcctttttccaggtcttggtcatgccgggacggccggcacccatgcgcttctccttgccgggcaccgtcagggtgttgacagaggcaaccttcacaccgaagatctcctccaccgccttcttgatctcgatcttgccggcgtccttggccacctcgaagacgtacttcttgtcggcggcaccggacatggcgcgctcggtgatgatggggcggatgataatatcgtaagcggtagccattacgcgtacacctcctcgatttttgcgagggcgtccttgtccacgaccagatacttggcgttcaggatgtcatagacgctcaggatggaagcgggagtggtcacaacgccggggatgttccgcgcgctcttgacgatggtctgatccacggcgggggtgaccaccatggccttgccgtccacaccgacggcggtgaggaacttgcggaagtcagcggtcttgatggcgtccatcttgatggagtcgatgaccaccatctggccctcggccaccttggcggagaggacggacttcagcgccaggcgcttgaccttcttattcagcacatagctgtaatcccggggcttgggggcaaacacgatgccgccgtgggtccactggggagcacgggtgctgccctgccgggcgtggccggtgcccttctgacgccagggctttctgccgccgccggagacttcggcgcgggtgagggcgctctgggtaccctgtctgcagttggcgaggtggttcttgacaacctcgtgcacgacggtctggttgggctcgatgccgaagatcgcgtcgttcagttccacagtgccgacttctgcgccggccatgttcaacactttcatagtagacattgatcaagcacccctttcttacttgtttctggcggaggccttctgcgggttgcggccggaggccttctgcgggttcttgctgatgtcagcgccggcctgcttgaccttgtggaccttgaccgtggacttgatggtcacgaggccgcccttggggccggggatcgcaccgcagaccaccagcatgttcagctcggggtcgaccttgacgacgctcaggttctggacagtcacctgctccacgcccatgtggccggcgccgatggtgcccttgatgatcttggacatgtggctggtggcgcccagagaaccgatctgacgggccacagggccggagccgtgggtctccttcaggcggtgggcaccgtggcgcttgatgacgccctgatagccgtggcccttgctgatgccggtgacatccacgaagtcgcccgcctggaaggcatcagccttcacgatgtcgcccacgttcagctcggcggcattctccaggtcgaactcccgcaggtacttcttgggagccacgccggccttgtccaggtggcccttctcgggcttggtgagcttgcgctcagagatgtcctcaaagcccagctggaccgcctcatagccttccttttcggaagtcttcttctgcacgaccacgcagggacccgcctcgatcacggtgacggggatcacatggccgttctcgtcaaaaatctgggacatgcccacttttttgccgatgatcgctttcatggttgttcctccttaaaggttattggtcggcttagatacgtgcgggttgggtcccgccgcattgctctgccgacatgacccgtctgcctcgcaagacggcagacatggacagcaaacaattttcaatctattttcgccgcggcgtgtacgtggcgaaaataccttgactcagccgccctgggcggcgccgccagtgcgcacactggcgagggggaatctaaagggggatttcatcccctctttaattggttacagcttgatctcgatctccacgccggcaggcagctccagggccatcagggcctccaccgtcttgggggtggacttggtgatgtcgatgaggcgcttgtgggtgcggcgctcaaactgctcgcggctgtccttgtacttgtggacggcccgcaggatggtgacgacttccttcttggtgggcagagggatggggccggacacggaagcgccggtgcgcttggcggtctccacgatcttctctgcgctctggtcgatgacctgatggtcataggccttcagccggatgcggatcatttctttctgagccatggttgtttcctcctgatttcgtaggtagtttcacgagtctcgacgacctacggcgagagaatttttctatacgcttaaccgtgcgtatcattccagctcatgaaaaataccggcgcatgatacggccggtatcctgtcatggcgcagcgatctacgcaacgtacagatccttctcagccgcccgattatcggacatactccccggaagttacctctttcgagcaatctcccggttcatcgcagtactcgccgggcgcagttctgccctccacgcgagctttattatcataaaagaaaatcttgctaatgtcaagcctattttctctgttttttatgaaaatatgaagatttttttggagggctggatctttttccaattcttccgaaattttggaggaaaaccgtcggtttcagcccttccggactgctgaaaaagagaggagggggcgttcccctcctcccttttcgttctcaataagccacaccccagtagatgtcggtggtgcatttcctgccgcacacggggcaggtgccctccgtgccgctctggaccaggggcatacagcgggagctgacaccggcccgctccttcatggccagctcacactccagactgccgcaccacttggaccggaggaagccgcccttcccctccacaatggccttggcctcctcgggagtttggatgtcgaaggtgttgtcctcccggttcttcagggccatggcatacagattgtcatggatgtgatccagcagggccttcacggcgctctccagctccgccagggccacggtgatcttctcgccggtgtcccgccgggcaatgacgcactgctccttctccatgtctttggggccgatctccacccggacgggcacacccttcatctcatactctgcgaacttccagccgggggagttatcagagtcgtccatcttgctccgcacgccggccgcgttcagccggtcccgcagagaggccgccgcctccagcaccccgggcttgtgggccgccacagggatcaccaccgcctgggtgggggcgatccgaggaggcagcaccaagccgttgtcgtcgccgtgggtcataatgatgccgccgatcatccgggtgctgacgccccagctggtctggtggggatagtggggctggttgtccttgccagtgaacgtgatgtcaaatgccttggcaaagccgtcgccgaagtagtggctggtgcccgcctggagggccttatggtcgtgcatcatacactccaccgtgtaggtctcctctgcgccgttgaacttctccttgtcggtcttgcggcccttgatgacaggcatagccagcacgttctccatgaagtccgcgtagatgttcagcatctgcatggtctcttcccgggcctcttcggcggtggcgtgcatggtgtggccctcctgccacaggaattcccgatggcgcaggaaggggcgggaggtcttttcccaccgcagcacgctgcaccactggttgtacagcttgggcaggtcccgccaggagtggatgatgttggcataatgttcgcagaagagcgtctccgaagtagggcggatagcgcagcggtcctccagcttctcactgccgcccacagtgacccacgcacattcgggtgcaaagccctccacatggtccttctccttctggagcagggactccgggatcagcaccggcaggtacacgttctcgtgccccgtggccttgaagcgccggtccagctccgcctggatattctcccacagggcgtagccgtagggccggtagatgaacatgcccttcacggaggtgtagtcgatcagctccgccttcttgcagacgtccgtgtaccactgggcgaagtctacgtcccgtgcggtgatggcgtccacctgtctcttatcctgtgccatagtcttcatccttttctctatgatcgcgccgtccttcggcgcagtttacactgaacatttattgtatccactctgggagaaaaagtcaactgttatggctccctggttccgcatttgcagaactgatattgcgccgaagcttgctctctttgatatttgagaggaaagcagggcgctttcctgcaggagattcgtccatataggcaggctatgtgctccggcggctcccatctgctgacggaagtacccttcttcgaaaccaagaacaggcggcgggccgatggcccgccgccttgctgcaattcttatttcgcgtactcgatgaccttggtctcccgcaggacgtggaccttgatctgaccggggtactccatttcctcctcgatcttcttggccaggtcccgggccaggatgaccatctggtcctcgctgacctgctcgggcctcaccatgacccgcacctcgcggccggcctggatggcgtaggccttatccacgccgggataggagccggtgatggtttccagctgctccagacgcttgatgtagttctccagattctcccgccgggcaccggggcgggctgcggagatagcgtctgccgcctgcaccagacaggccaccacggtccggggctccacatcgttgtggtgggcctcgatggcgtggatgatgtcctcccgctccttgtacttccgggcgaactccacacccagggacacgtgggtgccctccagctcgtggtccacggccttgcccagatcgtggagcaggccggcccgcttggcagcctggacatccgcacccagctcggaggccatcatgccggcgatgtggctgacctcgatggagtgctgcaggacgttctggccgtagctggtccggtagtggaggcggcccagcatcttcaccagctccgggtgcaggttccgcacgccgcactcgaacacggcgcgctcaccctctgccttgatggtgttctccacttcccggcgtgccttctccaccatctcctcaatgtgggtgggatggatgcggccgtcggcgatcagcttctccagggccaggcgggcgatctcccgccgcaccggctcgaagcaggagacggtgatggcctcgggcgtgtcgtcgatgatgagatccacacccgtcagggtctcgatggtgcggatgttgcggccctcgcggccgatgatgcggcccttcatctcgtcattgggcaggggaaccacactgacggtcatttcggccacctggtcggcagcgcaccgctggatggcctgggccaccacttcccgggcgcgcgcctcgcactcttccttcatccgggactcgacctctttgatcttgagggcggtctcgtgggtcacctcggcctccacctgagcgatcagataggccttggcctcctcggcggtgaagccggaaatccgctccagcatctccgtctggctgcgcttgatgactttgatctcctcgttttccttgtcgatggccgcatgcttctgggccagggactcctctctcttctccagagcctcggtcttgcggtcgaggttctcttccttctgctgcaggcggttttcctgccgctgcaggtcggctctgcgcgacttctcttccttctcgtactcgctgcggttcttcaaaatctcttctttggcttccagcagtgcctcttttttcttggtctcggcgctcttgatggcctcgttgatgatgcgctttccctcttcttccgcgcttgagatttccttttcagaaacggttttccggtagcgaataccgaggaagaagcagatcacgccgccaactgccagcccgatcagggcggcaacgacgtttccaatcacggtatcttctcctcctgtgtccggtatcctgtacgctttgggttttatatgcaggccgcatgggccgcatgggcagaaaacaatcggaaggcccctgttgcctgccgacaattatccgtttttagtttaatcgttctgccctcttctgtcaaggcaaatctgtatatttacccaaattccgccgaacgcttttggagttttttacgaggtctgtcaggtgtacccctgtctccggcccgccggcttcccgccgcggcgggaagccggcggattctcacgtattgatgtatgccgcggcggcataccccacctgatccccgtagtgcaccacataccagccgttccattcgccgtagatcgtaacagcggcgccgttgggaaggttggcgatcaccttgccggaggaggatggatagtcccgcaggttcagcgtgccgttgctcacagacacggtgccctgcatcgggtccatggggtagataaagggcaggccgaaatactccgtcaggccccgggcaatctgctgggcgatggcatcccagtggccctccagccaggtggcgtcgctgtaattgtcgtggtagccgatctccagcagtacagagggaaaccggggctggcggacctctcccagtgaagtggtggggcgggtagtgaccttgttgggcaatggatagatcttccgcagctcctgggcgatgagctctgcggcccgctgaccgcccacgctgccggggtaatagaaggcaataatgccccgttcctcgccatagcgcccctctggggcggcgttggagtggagcgccagatacaggtcatactccccctgattggcctcccggatggagctgccggcagtcatctccggccggttgcgctggtactggatgccgttggagagcagatagggcaccagggcgtctgccagcaggttcatgttgtactcctcggacccgctgccggtaacgtacatgttccagtcctgagtggacgggctcagatagatcttgggcatggaattgtccctccttttttcccagtctatggcgtttccctcaaaaatgtgatacactggcctggaaatatcagagggaaaggaatcatgccatgaaagcggaacggaattaccccagatacaccgtcacggccaaagcggaggccgccatcctccggggccacccctgggtctatgacgcagaaattacagccacagagggacaggcggaaaacggcggcctggtggacgtgatcagcaaaaagggccggtatctgggtacgggctttttgtcggaacagtccaagatccgggtgcggctggtgtcccgcaacgccaatgaccagttcgacgccgccttctggcgccggaagcttcagtgggcctgggaataccggaagcgcgtgatgtctccggaggacctggacgcctgccggatcatcttcggggaggcagatgcctttcccggactgacggtggacaagttccacgacctgctgtccgtccaggtgctgtccgtgggcatggagcggatccaggacatcctgctgccggcgctggcggagctcctccgggcggacgggttcccgatccgcgggatccttctccggaacgacgtggccctgcgggagaaggaggggctgccccagggcaaggggtggtatcccctgccgggggaagcggcgccggattctgcagtgacggagatcacggagaacggcgtgaaatatctggtagacgtggagaacggccagaagaccgggttcttcctggaccagaagtacaaccgccgggcggtggggcgcatcgcccggggcaggacggtgctggactgcttcacccacaccggatccttcgctctgaacgccgcgatgggcggggcgaagcacgtcaccgccgtggatgtgtcggagtccgccgtggagatggcccgggccaacgcggcgcgcaacggcctcaccggcgcagtggactgcgtggccgccaacgtgttcgacctgctgcccgcgctggagaaggagccgaagcggtacgacttcatcatcctggacccgccggccttcaccaagtcccgcaggaccgttgccaacgccatctccgggtataaggagatcaactaccgggccatgaagctgctgccccggggcggtcttctcgccacctgctcctgctcccacttcgccacggaggagaagttcgcagccatgctccacagcgccgcccgggacgccggagtgcagctgcggcagatcgaggcccggcagcaggcctgcgaccaccccatcctctggggcgtcgaggagacgaattatctgaagttctacctgttccaggtggtatgacgccgccgtttcccaacgtgccgccctgcgcaaacgggccgccccacaaggggcggcccgttttttatgggacatataccgttttcagaggaggatctgtcccggatttcagccggttctctcagcccacttccaggaagcggaccacgccctggtacacatacagcgtggcgctgtctgcataggctctggcctcagtgagggtgacccagctcttggtctgcgtgttgtagcaggggacgctggcagggaccgtgtaggtccggccgttcaccgtgacggcgcccttgccgctccaagcggtgttgggcacgttccgcagctcgtcaggatagaccaggctgccgatccgctgggtgtttccagaggtgacgatggtgatgcccacgatgtcgccgttgcgcaccacatagccggtctcaaaggtgggcgtgctcttgcccgcaccgtattccacagacagctgggcattgccctcccggttgccctcttcgtcatagttcgcggtatagttggcgcggccgaagatgtagccgccgccgatggcggaattcagcacgatgaccttcaccctgcctgcccagtcggtgccggcgtaggtgatctgggaagcgggcacgctgccgtccgcgatctgggacaggctgatggcggtgaggccgctgccgtcgttctggaagacaaccacattgtccgccagattccggctgcccagcttgcgctccgccacattcagctcgccggagacgccgcccgtcaggcgtgtcagggacaggccgcccttccggctggaggagacccgcaccagctggccgttcagccgctccacatcgctggcggagagactgaccgagcccttcacctggatgccgcagagcaggtccaccgtggcgcttccgctggagacctcggcgatgccgatggcattgccggtggccgtgttgccgctggccgccaccgcgccggccacctgattgtcctcggtcaggagcagagtgatctggtcgccgggcttgaactgggagaccgtctgcatagcggtgggcagcacgttgaactcatagcccaggaccgtgatcttcgtgggctccttgggattgggataacattcctcatagtagccggtaatccgggtgtcgcacacgcggatggagttggtggtgctggaataggttgccacgtcgtacttgcgcatatccccggccgtggcgggcaggccgttcttgtagatggcgtatccgctggtgccgccggccagagagctgaagcccgaggtggaccccttctcatagatgatgaccgcctcgttggacgtggtcccgccgccgccgacgaacacatagtccacaccgccgcctgcatccagatacagcgtcagggaggtgcccgcgttcagccaggagtagacctcgctccacacggactccttgccgttgtagtagacgccggtgtcgttgtccataacgtacttggtaccggtggtatccgtcagctccgtggccttggccgtggagaggaccacgaccttgctgctgcccacggaatccggcacaaaggtcagggcttcattaccgttcttgctgagcagcagtgtccccttggtgccgttgagcatgccgttggagaccttgccgtccgccagggagtaaactgcgccggaggccatctgcagcgccgttccggcgccccgcggtccgtcagccgtggaggagaccagcatctgccccgtccgggtctcgcccagtgtggcgagatagctgccgccctctttctggtccgcccgaagcagattcaaaaagagcttggccgcctgtccgcgggtcaggccctcgtttccagttccgctgacgccgtcggtcaggccgatgagcgcggcttccgccatatagctgtccggccagacgccgccgacgtcttcgtccttgtagcccagcatccgcagcaggatggtcaccgcctggcccacggtcaccgtgcggtcggggtggaatttcccgtctgcgtagccggagatgatgtttttgcccttggcggccatgttgatatacggcgccgcccaataagagggcttcacatccgaaaataccgtgacggtccggtagcgtcccagctcattgctgccgttcatggcgtagaccgccatcttgcagaactgcgcccgggtgaggacagtgccggggcggaaggtcccatccccatagccgtccagcacaccgagcagacgcagggattccaccgccactgccgtgctcttgtccccgacatcggaaaatgtgactgctgcggtattggccgcccccgccggcaccgccagcagggaaaccgccatgcacacggccagcagaaatgtcatgattcgtctcttcatcagtctctccctctcattctgcccgcagtgcttccacgggctggagcctggcggcctttgccgccggataaatgccgaacaaaattcccagcgccaccgacagcgtaaaggcgcacagggtaatccacgccgccgggtagatggtcatctggaacatcagccgtcccaccagcaggctgccgccggtgccgatgaggatgccgatgatgccgccgattccgcagagcatggccgcctcgatgaggaactggatgacgatgctgctccgctcggcaccaatggcccggcggatgccgatctcccgggtccgttcggtgacggtcaccagcatgatgttcatgatgccgatgccgcccaccagcaggctgatggcggcgataccgcccagaatcagggagatcatgcccatctgcttgttctgctcctgttgccaggagttctcctggtccacctggaagccgcctgcgttgggattaaccactcccttcaaaaagccgccgatgcgggagctggcctcgatcatgtcctcgctgctgcgggtcttcacgatgaactgctccggtgcgtcgccgcccagcacccggcgggcggtgtagggcagaatgatgacattgtcgatctggctggcggatgcgctttcaccggtaaggcggggggcatagacccccaccacctcaaagctctgcccgttgagctggagcaccttgcccacggggtccgcggcgtcgaagaagatctttgccgcccggtcccccagcacacatacctgcttgtagccccggatgtccaacacggacaggtcccggccggaggccagcgtcaggttgttgcagatgctgtactggtcgctgccgtagtaaatgctgggcggcacgtcgccggtgagattgccgttttcatcgtaattatagctcatattggcggtgctcttggtcccgtataccaccgtggcgttgcagtacgcctggggcgtcacgcccagcacatactccttgatgctgttgcagtagtcgtacagcgccggaaagtaatcctgacccaggctgttgccatcttcgtcatacaggtagttccagatgttgacggtgagcttgttgctgcccatggcctcgtactgctccatggtcttttccgtatagccgttgatggcggacacgatggtcatcaccgccgcgatgccgatgatgatgcccagcatggtcagggcggaccggccctttttgccccagatggacttccacgccatcttcacggcctgttggatattcaaagccagtccacctcctgctcccggtcctcaatgattctgccgtccgccaggcggatgacccgccgggccgtggcggcgatgccgttatcatgggtgatgagaatgacggtgctgccctccttgttcagctcctggaggaatttcagcacctcctgcccggtgtgggagtccagtgcgccggtgggctcgtcggccatgatgatgggaggcttggtggcgatggcccgcgcaatggccacccgctgctgctggccaccggacatctccaccggccggtgcttgatgcggttcgccagccccacccgggccagggcctccagggccatgtcccggcggtcatcggcattcaccccctggtagatcaggggcagttccacattttccagcaccgtcaggctctggatcaggttgtactgctgaaagataaagccgatctgcttgttgcggatgtgggacagctccttgtccgtcagctcccggacgtccgttccacccaggagatacgtcccccgggtggggatgtctaggcagcccagcacgttcatcatggtggacttgccggagccggactggcccaccaccgccacgaactcgccctttccgatggtcagggagacgccgtccagggcccgtacctcgctctcccgcccttcgccatagatcttatagacgtcccgcagctctactaagttcttcgccatgggcatcaaccccacgcctgcagggactggatctgtgtgaagacctcggtcccctcttccacaccggacttgatctccacattggagttgtcggagatgccgatctccaccggcaccgcccagaagccctccgggatctcctcgctcagggtgggcgtctcaatggcgttgtccggccgactgccctttacaaacaccacgttcacggtggagccgtcctcctgggtcacagtacgcacgcactggagcggcaggaccaggcagttgtcattctcactggcagttagagtgtagtcgatatagctgttgacctgcagggtgccctcgctgttgtccgccgagatggtgataggataggtcgccacgccgttgttcaccgtgctggagaggctgaccgtctccacggtgccgaaggccggggtcccccactggctcagctccaccggcatccccggcttgatgtagctgatgttccgctcgtccacattggcggtaatcaccacgctggaggtgtccgagatggtcaccactgcggtatttgcagcgatctcatcgccgggctggatggtcaggccgattaccatgccgtcaatgggagccttggcgttgcagttggccaggttctcctccgcagtcttcagctcctcccgggcagtgtccaggttctgctggatggtgaagagctggctctcgctctcctccccgtcgatgcgcaccagcacctggccgggcgccacctgcaggtagtccaccagattgctggaaatcaccgtgccatccaccgtggaaaccaggtcgccggtgcggtagtacgccagcttgccggcctcataggggtacacggtctcaccgttcacagtggcggtggcagaggccaccatatccgccgtcagggctccctcattctccacgataatgtcggcggagaagagcttggacccctccggcgtgatgcggctgaccatgtggaccgcctccaccgtgccgggaacggaggtcatcagggcagggatcgaaacattcaccgtctgtcccacctgcaggtcgcccgcataggcgtagctgtaatactgctccagccgcagacgggtatcgtcggagaggaccgccaccttctggcccttggtgatggaatcaccgggattcagcgtcacggtctccatcagcttgccggcatagccggcggagagattcagtcctgcgatgtctttctgggcctgggagagctgtttctcatagccctccacattgctccgggccttctgcacggcggtctctgccgccggagagtcgatggtgaacagcggcgtgccggcagtcaccgtctcaccctccgccaccagcacatccaccactgtgccgacagtggtgatggtgattgtctcactgctcttggccttggtcaggccgctgccctggaccgtggaggtgatggaaccgtactgcacaatgtcggtgaccacctctccctcatcgctgctcttgccgcccagcactttcagcagcaccaccgcggcgatcaccagcagcagtgccagtatgcacaggcggatgatccggcgccgcttcttccgcgggatcgcctgccaccgggccttcaggtttacgcgcgtctccgcgggggcggcgctgtccgccgccgtctcctccatcgccggagcggtcgcttcctgttctacattctccaggtctttgacttcagccatggtatgtactcctcttcttgttcttcacagatgcatcaactgtattgcttataatagtacagtatgtagggcaaagcaataacaaaacagttacagtttctcccgcggcctgtatctcttgtaacctgcgggtatgtgtgaaaaagtgctccccggaagccggggagcactttcaaggtcattcagaccatggcggcgcgccgggcgctgaagcgctgatagaggacgatgccaaccaccaacacaaagccggcgatgtcggtggccgtgccggggatcatcatacccaggccgcccacagccatggccacccgcagcagcgcggggatgggccggtacaggaatccgttgagggccgccgccacgccgaagatgcccagcagggcgctgatgcagatctgcaccacctggaaggcaccggtcacatccacaaagagcatctgggggctgaaagcgaagatgtacggcacgataaaggccgctatggccagtttcgtggcgttgaaccctgtcttcatgggatccgccttggcaatggcgctgccggcataggccgccagggccaccggcggcgtgatgtccgccacaatgccgaagtagaacacgaagaagtgggccgccatcttggtgacaccgatggagggatccatcaggatgggagcgcaggtggccgccatgatgcagtagttggcggtggtcggcacgcccatgcccagcacgatgcagcagagcatggtcagcgccagggcgataatcatgtggccgccggagaggctgacgattgtgctcaacagcttggaggccaggcccgtcaccgtgatgcagccggagataatgccggccacgccgcaggccaccgccacagtgatggagcccttggcgccgccctccagggcgtcgatgatcttgccgaaggtgaggaagtcctcccggttgctgctcttgctggcgatctccaccacgttgttgaccaggcctacggccacggccgccacgattgcgatggcagcggagaaggccatggtgtacatattggtggagaccatgaccaccaacagcaccaggggcgccagaaggtagatcttgggcagcagctggcgcacgcggggcagctgctctctgggaatgcccttcaggcccagcttcttggcctccagatggacggcgatgtagatgccggtgaagtacagcaccgccggcaggatggcccgcatggcgatggtgccgtagggctcgccggtgaactctgccatcaggaaggctgcggcgcccatgatggggggcatgatctggccgccggtggaggcagccgcctccacggcgccggcgaactccggcttgtagcccgtcttcttcatcatggggatggtgacggagccggtggtgacggtgttgcccacggaggagccggacaccatgccgcacagggcggaggagatgacggccaccttggcggggccgccgggggcggcaccggccacggcattggccaggttgatgaagaactgggcgatgccggtcctctccaggaaggcgccgaagatgatgaacaccacgatgaacttggcgcacacgctgatggggccgccgaagatgccgttgaaggtgtagaacatggtgcggatgacctgatagagggtcatcttgaaatctgcactgccgcccaggttgaagaaggtgtacaccagcagcacaccggccacgcacaggatcggcaggcccacgcaccggcggcacagctccaccagggccaggataccgatgaggccgataatcatgtacaggtcgttctgcatgacccgggcggacatctggaccacgttctgggcattgacggcgtagaaaaagtaggcgccgggcccggcaatcagcagcacgatgtcataccagggcatgtggttgacccgctcgtccccttttttggccgggaaggtcaggaagccgaacagcaggatcagccccacgaacatgggcagccgaacctcctgccgggtggaaaggaacacagtgtcgatgatgcagtaggcggagaacgctaccatcagccagcggatcaccagcttcggcagaccctcccagacccgggtgttggactcccggtcgtattttttcatgaccgcctccacatcggcggcggtccccacggaggtatcgtgggcgccggtatcctccggcggcacaggctccgtcttgtgtttcttgaacagtgccatagggtcccctctcatttcgcaagatatcttccaggccgggaccgacccgaagtcaaggaactacggcggagattccgccgtagttcccgatcaggctccgcctgagatcacttggtgggtacgtcaaagcccttttcggcgaagtacttggccgcgccggcgtgataaggcaccgcggtgacgccggaggcaaattccacatccagctcccctgccttgtcatgggccagattgtccatgttctcaaagatggtgtagcagatgttgtacacatcatcctcagacacatcgtcccgggcgatgacggtggctaccacggctacggtcttggtctccggcacgccctcataggtgccctcggggatgatgtactcctcgtagtagggagaggactcctggagcttggcaatgtgctcgtcatccaggcccaccagataggtgtccttggcggtggccagagtggtgatagccacggtgggggcgcctgccaccacgaaggcggcgtcgatcttgccgtcctgcagggcgtcggcgctggcgccgaagtcctggtactgggcgttgatgtcatcctctgtcaggtcataggcggccaggatatccagggcgttgtagtacacgccggagccagaggcgccgatggagaccgtcttgccctccagatccgccacggacttgatgtccgggtcacaggtgacgatctgcacctgctccatatacagagcagcgacagtggagaaatccgcataggggaacccctcaaacagccgctcgccgttataggcgtagctcatcacgtcggactggacgaagcccagttgggccacgttcatctgcatctgctcgatgttgtcctgggagccgttgctgaccacggccgtgaccttggttccgttgccgttggtggtgatggcctgcgccagcacgctgccgaagccgtaataagtaccctggtcgccgccggtgcggaatttcagctccgtgccggtgccggtgacggaagagacgctccagttggtctgggcagcctgctcagtgccggtgtcggcgggggtatccgtctcctccgtggagggattgccgccgcagcccgtcaggaccgccgccagcatcagcgcggcaagaagcagggataagcactttttcatgtttccattcctcttttcctgttagtcgatacagctcgtatgtcgctttgcatatcataccttatcctcattcattttacaaggttttttttacaattttttaatatttctgcaagtccaatttgcacaaccttcattttcccgtcccacctctctgaaatgccgaaaggccggccccaccggggccggccttctgccgcgtatgcttatttgatgaccaagatgagctggccgcccttgacggtctcgccctccttcaccaggatctccgacaccgtgccggacatccgggcggtgatggcggtctccatcttcatagcctcgatggtgaccagggtctggttcttctccacggtgtcgcccaccttgacgttgagcctgctcaccgcgccggggatagaggagcccacctggctcttgtcctccgggtccgccatggggaccttgacaatgttcttctgggcctcctcgtcgggcacctgcacatcccggcggatgccgttgagctcaaagctgacggtgcgcatgccctctttgtccacttcgcccaaccctaagtacttgatgaccagggtcttgccgtcggcgatgttgaccttgttggtctcgcccaccgccagaccgtggaagaacacatggctgcccagccgcatgatgtagccgtactccttctggttcttgacataatcctccactaccttgggatacaggcagtagctgaggatggcccgccaggagggatctgcatcaaaggactgcatctcccgcttcttctcctcaaagtccacggggggcagcagctcaccgggacggcaggtgatgggcttcttgcccttcaggaccacccgctgcagctccttggggaacccgcctgcaggctggcccatcataccggagaagtagctgacaacactgtccgggaaggccaggctctcgcccttctccacgatgttctccggggtcaggttgttctgggtcatgaagatggccaggtcacccaccatcttgctggagggcgtcaccttcacaatgtcgcccaccatctcattgaccttacggtagttctccttgacctccacaaaccggtcgcccaggcccagagactccacctggggcttcaggttggtgtactgaccgccggggatctcgtagcggtaaatatccgtggtattgtactccaggccgccctcaaaggagtcgtaacgcttacgcacatcctcccagtaatcagtgagggtctggagccggtccagatccagcccggtgtcccgctctgtgtccttcatggccgccaccacggcgttcagagagggctggctggtcatgcctgccatggagctgatggcacagtccaccgcgtccacaccggcctcggcggccagcagcagcgccgccacctgattgccggtggtgtcatgggtgtggagctggatgggaatgccgatctcctgcttcagggtggacaccagcttcttggcggcgtaaggcttcagcaggccggacatatccttgatggcaagcatgtgggcaccccggtgctccagctctttcgccatcttcacatagtagtccaaggtgtacttgtcccgcttgggatccagaatgtcgccggtgtagcagatggtggcctggcagatcttgtcctgcttgaggacctcatccatggccacctccatgccggggatccagttcagagagtcgaagatccggaacacatcgatgccgctgcgggcggcctccttgatgaactcccggatcacgttatcgggatagttggtatagcccacggcgttggcgccccgcagcagcatctgcagcagcaggttgggggccttctcccggatcaggtccagccgctcccagggggactcgtggaggaaacggtaggccacgtcaaaggtggcgccgccccagcactccagagagaaagcatccgccaggatctcgctggtgccctccatacccttgacgatgtcccgggtgcggacccgggtggccagcagggactggtgggcgtcccggcaggtggtgtcacagatcagcagcttcttctgccccagcacccagtccgccacggccttgggtcccttggcgtccagcatctgcttcaggccatcgggccggttgccggtgaccggcgggaaccggcagggatcgtacatcttgtgtccgtcccgctccttcaccacgatgttcccgatgtacttgagcatcttggtggcccggtcctggccctcgttcagctcaaacagctccggcgtctcgtcgatgaacttggtgtggcagcctcccgccaggaaggtggggttctgcaggatgttggagatgaaggcgatattggtcttgacgccccggatgtggatctcccggatggcccgtccggccttcaggcacacgccctgaaaggtgttatcccaggtggtgaccttcagcagcagggagtcatagtagggggagatctcgctgcccacgccggcggtggccgcgtccagccggacgccgaagccaccgggagaccggtaggaggtgatcttgccggtgtcgggagcgaagttgttggacgggtcctcggtggtgacgcggcactggatggcgtagccgttcaggtgcaggtcactctgcttcctgatgccgatgcggggatcgctgagaggacagccctcggcgatcagaatctgagagcgcaccaagtccacgcccgtcaccatctcggtgacggtgtgctccacctggatacgggggttcatctcgatgaagtagtggtgcccttccctgtccaccaggaactccagggtgccggcgttcacatagcccacgtgctttgcgatcttcaccgcgtcttcatacagggcctgacggatcttcttgtccacggagaaggcggggctgaactccaccaccttctgatagcgccgctggagagagcaatcccgctcgaacaggtggaccacgttgccctcttcgtcgcccagcacctgcacctcgatgtgcttgggctccaccaggaacttctccatgaagatgtcgtcattgccgaaggccttcttggcctccgccttcaccagatcgaagttggtgcccacctcttccacggtgtcacaccggcgcataccgcggccgccgccgccggcggccgccttgagaatgacggggaagccgaactccatagccagcttctgagcagcctcccggctcttcaggggctctgtggtgccgggggtggtgggtacgccgcaggccacggcgatctgcttggcggacagcttgtcgcccatcaggtccagaacctgggaggagggtccgatgaacttgatgcccgcagcctcgcaggcccgggcaaaatccgcgttctcactgaggaaaccgtaaccggggtgaatggcatcggcgccgtgcttcttagccagctcgatgatccgggggatgtccagataggcacccagggggctctcgttctctccgatcagataggactcgtccgcggcggtgcggaagaggctgtatacgtcctcattggagtagatggcaatggtctggaggcccaggtcgtgacaggcccggaagatccgcatggcgatctcgccccggttggcgaccaggaccttcttgaatgcttggctcatatatcgttcctccttctctccgccggcaggcgggaatcttttggttcagcttagtatacaccaaccccgccgccggttgcaacggcttccagcccggatttgtcaattttatcccgccgtcatattttgagcctggctgatggggcgctttgtctatttcagcaggtcttatgtctgctatcagcggcactgcggcccgccgggggcacaaaaaagacggcgccctcagggcgccgtctccggctcatctcaggcggtcctgccagcggctgcgaagctgaaccacccccgggcgtcccgctggacaccggagaagccgtcccgcagtgtccagcccgtcacgctggtgtagaggggcgccgcggccccctcctctagcagcagggcctccgcatcgtggaggcaacccatccgggcctccccctcctccgcgccggcgatgaccgacagcagggtatcataggcgctgttggcgtatttacccaggttctccggcttatcggagccccactgcatcaaaaagcactccgcatcgttgcccaaagcccggatctccgttcctgccagggtgaaggtcccctcctgcagggcggtgtccagctcttcccggctgacgccgcgggccgtcacctggaggcccagggcgctctgccaggcgtctaccagcgcctgggccacggcggcgccgttcccctcgtccacgtagagatattccagctcccccaggtcccgggcgtcggcgtatccggcctccgccagcaggccgcgggcctcctccgccagctcgtcccggtgcgcggggtcgttgtccagcagcacgccgccatctgtacggaaatcctgctccccgctccccggcacgccgggagggatcaggccctcagcggcatacgccgtggcgcccgccgcctcagcagcggcagaacggtccgccgtcagagtcagcgcccgacggacccgggcatccatcagcgtatcctgcgcgcagttgaacaccaccgcctgaacgctcagctcccgcgccagggtccggctctccgcctcgatcaaggccgtcagctgctccgccgggaggatgcccaggaaatccacctccccggcgtcgtagaggtcctgtcccgcctctgcggtctccgcaaatcggaacgtcagggtctgcggcccggagaaactgttgcggtaggtctcgctggcctccagggtcagcgcctcaccagcctcatacccgctcacctgatacggcccgttggtcacaaggcccgtaaggtcgttccaccaaggggccgcctccgccggctccgccgctgcttcggcggtctccccgtcagcggcagcggtctcctcctgcagcaagtcctgccgcagaggcatggtggcgggcgcagtgcagacctccgtcaaaaaccagtcgaactttccgttcagcaccaccaccagggtgctgtcatcctccgccgtcacctgcagcagcgacacgtcgccggtctcccgcacggcgtcgtagcctgctaccacggacagcagcgacgcgctgggggaatcgttggccggatcggccagccgctgccaggcaaagacaaagtccccggcccggaccgcccggccgtcggaccactcggccttccgcagcttgaaggtccaggtcacggtgccgtcggcattctcctccgtactgacgctcttggctgcgccgttcgtcaccgtggtcccgccggagccgtctcctgttttccgcatcagattttcatacaggtggaccaggacggtctggtccgccgtctctgtggcgtagatgggatccagctcctccggcgcgccgcccacgcagacggagagggccggcccctccccgcttccgccgcagccggtcaggctgagagccagcagcgccgccgccaagaacagcgcccaccggcgcttccaattcttcatatcgtcgttcctcccgctctggagtctaaaacgggcacccctgccgggcacccctgcatatcaaaggacctggtctattataaagattatcaggcagcttgtaaagttacgagccctcaaaaagtaacaaataattacaaaattaaaaatttattcacaaatcacagcaagaactcgaaaatgccctgtctcccagccggaaccagtggcgtgaaaagcgccgggcgcggatttccgcgtccggcgttcaaagccgttttcacgctgtggtcaggcggccgtcctcgtcgaacttcaccggaacgatctcgttccgggtcttctgggcgatgtcgtcgatccgcatcttggcaggatagtcggagatgaaagtcactgccacgccctgccgcctggcccggccggtccggccgatccggtggacgtagtcctggttttcgtccggcacatcgcagttgaacacgatgtccacatcatccacgtcgatgccacgggccgccacgtcggtggagacgaacacccgcagctcgccccggcggaacttctccatcacctgctcccgcttccgctggggaatatcgccgtggatgcactccgcgtcgatgccccgcatctgcaggaacttggtgatccgctctgtggagcccttggtgttgcagaaggccatgcaccggtcgaaacccgtctcgttcagaatcttttcaatggcgtctgccttaccgtcgtggggcacgtccatgcggaactgcttgatgtccggcttgttctgctcatcctcccggacggtaatctccgccgcgtcccgctggtacacccaggcgatgtccatgacctcccgggagatagtggcggagaagagtcccaggttcttccgcttgttcatcttgtccagcaggcgggtcacgtcatggatgaagcccatgtccagcatccggtccgcctcgtccagcaccacggtctgcgccgtgtccacccggacggtgcggcgcttcatgtggtcggaaagccgtcccggcgtggccaccacgatctgggggtgcttcttcagcgtgtcgatctgccggccgataggggcgccgccatagaggcacaccgtccgcacgccgggcttgaaggctgccaggtcccgaatctcgtcggtgatctggatggccagctcccgggtgggggccaggattaccgcctggacgctctcgtcctccgggtccacatgctccacgatggggatgccgtaggcaaaggtcttgccggtgccggtgggggccttggcgatcacatcctgccagtccatcataggcgggatgcagcctgcctggaccggggtggacacctcaatgttgcgtttttcaatggcgcgtatgatctccggcgacaggtgcaggctgtcgaaccggacgccttccgtaaattccatggctctcttcctctttcgtttatccgttggcctggccggcgcggctgcgcccgtagatcatgggcactaccaggactaccagtgccagcagggctgagaagaacgtggtctcgctggtcaccatagcgccggcggccaccaccaggcccgccagcatccaaagccagccggcaaaccggtggacctctttccacaacggcggattgtttaccgtaaaggagaaccgcagggccagcttggcatcctccgtgcagtcgaacatgtgggagcccagcagcatcagcaccagacccagaatgcagggcgtgtagaagttcagacttagcccctggccggaagtctccaaaatggcgccgctgcagaacagcagggaaatggttggaaagccccagcgccccatgagccggttaaacgccggtgggatcttcatccgcttttgatactgcagcagcatgaactgcgcgacagcctccagcaggcacatcaaaccgggcaggaggagcgccaccgcccaccggggcagggagtcatcctggccgccggggccgatcaggccggtctccacaatctccgggatccggtcccacatccgcacgcccaggatcattggcagggcgcaggccgtcagcgtcacgatcagcagcgcccgctgcttttccggcgacaggtgctttccaaatatctcagccccccggatttccaggtcgcggggcagggcctctctcttttttcggttgctcatagtcagccgggtcctccttctggggtccgcaggcagatcgctctgccgtcaaaatttttcttttctccgggcttcctatggactgcgccgggggaaacgggtattattatatatggaaaatacgcttttgtaaagcactgtcaaggaaaacgcccgtccatgcggagcagccccgcccggccgctccttgctctcccggagaaaagcagtcccggaatatgttcgcatttccccgcattcctccgttttttgagtaaatttgtcttataattgtagtaaaattttgtattgtgccccgtaagattcacaaattttatggtacattgtaagaaccagaaagctccagagcggatacggaggtgccacgtgaacggcggaatggattatgtacgcattttgcgggacctgcgggaagatgctgacaagacccagacccagatcgctgaggtgctcggaacatcccagacgatgtacgcccgctatgagcgcggggccaacgagcttccgatccatcatctgatcacgttgagcaaatactacggggtcagtacggactacctgctgggtctcagcaaggaacgctgaaacgcggacagggagagctccctgtccgcgtttttcaggtttcttcaatctgccggggcaatctcctgtgcttttgcctcgaccacgctgctctcgtcggcatcgggcaggtccgcggtaaagtgatctgctgcctgcccggtcatggtgccggaaaactctgtaagcccgttgtcgccgctgacagtctcatagctggtgccgtccccgttgtcctgggacacagtccaccggtccaggtcgccagtgacgtcaatggtgacagtccgggtctcccggctgccgtcctcatgcaccacatccatatcgtaggcgtagtgataggcacccgcggtctccatggcctcggtgatgtcaatctcctcaccctgagcgtggaggatcagccggccgttctccttggtgaccggctccccggccgctacggtgacatacacctcgttgccctggttatcctgggctaggtactgatttccggatgtccagacgatggtgaactgccggaagaactccccgtccgtggccacgttcactgccccggcggtgacggccagcgccatcaccatggcagcggcaatggccgcgccccgcaggacccggggcatccgctttctgtgcttcatctcctgcattttctgaaaaacctcctgtttggcttggtcggaggcacggagatgggaaaaggtctcctggtacagtctcttgtcgatcatgactctgcctcctgtaagatcagtttcagcttccccctggcccgcatgagccaggtctgcacggtggacggattggcccccatggccgccgcgatctcctgtacggagcagtcttcgtagtagtagagatacaccgcggcccggtatttgggcggcaggcccatcacgtgctggtagagctcactctgctgcggcgtgtcgaacaccggctccccggcctcctccagaggcccggtccgcctgcgccacggagagcggagcagcttcttgctctcgttcaccgccacccggacgacccagtaccgctcatgctccggcgaccggaagggctttcgctccagatagagcttcagcagcgtctcctgcatcacgtcctccgcgtcggcgcggtttttcaaatagctgtatgccagccggaacacggtgtcgccatagcgctccaccgccccctcgaatgccgcgtctgtcaatctcatcacaccttgctgttgggatgggcggcagcgccgcccggaaaggcctttctatcgggaatatccctcactggggtgaaatatctcacccagtccgaaagtttttcaaaaatcatgcgccccgcgcaggagcgggatctcgaaaaccggaaacggctgagccgtttccggttttctgcgtttttctcagatcggatcacttgtggggcacgtgccagatgttgtcggcatactccgccacagcccggtcggcggcgaacacgccgctgcgggcgatgttgtgcaggctcatgcgattccaggccgtctggtcccgataggtctccgccatgcgcttttccgcctggcagtatgcctggaagtccgccagcaaaaagtactcgtccgcggggctgcccccggcgccgaacagcagccgctggtacaggtcgtcgtaccggacaccgtcccggaagccggtccgcagcgcgtccaggcaccggtgaagcaccgggtcccggttgtacagccgctggggcacatagccttcccgcttcagctgctccacctcgtcggcccgcaggccaaagaggaacatgttctcgtcccccagcaggtcgtgcatctccacgttggcaccgtccagggtgccaacggtcagggcgccgttcatcatgaacttcatgttgccggtgccgctggcctccttgccggcggtggagatctgctggctcacctcgctggcgggcatcagctgctccgccagggagacccggtagttctccagaaacaccacctgcagcttatcgcggcagatagggtcgtggtcgatctgatccgccagggagttgatgaggcggatgatccgcttggccactgcataccccggcgccgccttggcgccgaacaggaacgtgtggggctgcgtgatggcgttggggtcgtcctggagcttctggtacaatgcgatgatgtgcagcacgttcaaaagctgccgcttatactcgtggagccgcttcacctgaacgtcgaagatggcgtccgggttcagctccacgccccgggtcttcttggcatgggcggcgaaggccgccttgttggcccgcttgatggcacccagcctctccagaacagaggcgtcatcggcatagtcatccagctttttcagggcctgggggtgcagcagatagtcgtccccgccggtcaggtcccggatcaagccgtccagtccggggttgatctcactgagccagcggcggtggtcaatgccgttggtgacgttccggaatttccagggctccatgccgtaggcgtccctgaaaacgtcctttttcaggatctcggagtgtaggccgctgacgccgttgaccgccatgccgccggcgatgcagaggttggccatgcggacctgaccgccccagacgatggccattttctccgtcttcttggggtcgtggtagaagtcctccaccttcttctgccagcggcgggagatctccaggataatctgccacacccggggcagcaggaattccaccaggctctggggccagcgttccagcgcctccgaaaggaccgtgtggttggtgtaggccacggatctcgtggtgatgtcccacgcctcatcccagtccatgccggcgtcgtcgatcaggatccgcatcagctccgggatcaccagggccgggtgggtgtcgttgatctggatgacgttcttctcatggaagttcttcatggtgccgtacagttcggtgtgcttggcggcgatggactggagggtggcggacacgaagaagtactgctgtttcagccgcagagacttgccctccagatgattgtcctccggatagaggaccttggcaatggtctctgccatggcctcgtcctccgcggccttcaggtactcgccccgggagaacagggacatatccaccggctgggtggaccgggcgtcccacagccgcaggacattcacatgctccgtgccgtagccggcgatctccatgtcgcagggcacggcctggaccaccgtggcgtcctcattgacgatgtgcaggtggccgttgtcccagaactcccgcacggtgccgccgaagcggacctcctgggtctccgcgggctttggcatcagccaggccgcgcccaggtccttccagttgtccggcagctctacctgctggccctccacgatcttctgcttgaagatgcccagctcgtagcagatggaatagccggtggccgggatctccagcgtagtcatggagtctagatagcaggcggccaggcggcccaggccgccgttgcccagggcggcgtccggctcgatctcaaagatgtcggccgccttgaagcccaggtgctccagcgcctcccgcagctggggcagcagccctaggttataggcattcttcatcaggctgcggcccatcagaaactccagagacaggtagtgcacctgccgggcatgctgctggcgggccttctgacgggtctccacctcccgcagagccatcatgtcccgcaggaccagggcgctggcccgcatcatctctccatccgttgcctccgccgccgtctttccgaagctgaccatcagcttggcggtgagggcgttctccagggtctgtgtggtaattggtgtcatgcgtctccttactccgccggctcctgtttcccggcggtccccttcttgggtttggtctctttcttggcaggcgtcctcctgccgcttttggcggccgtctttttggcggccggtttcttggctgccgtccgctttctggcggcaggcttcttctccggtgcggccggagcggcctcctcagccgccggctcggcggacgattgtgccgcttccgcggtcggctgcggagcaggttcgtcagatgcgggctccgccgcttccgcgggggcggtctcttccgcgggggcggtctcttccgcgggagcggattcctccgccggggcggactcttctgtccggacgggctcctccgcagggggccaaggctggccggtgacggtgctgtaaatgtgcaggtactcccccgcgctccgggcccagctgaaatcgcaggccatagcccgcgcccgcagccgggcgaaggcgtcgggatagtccttgtaaagatacaccgcctcccggatcacatacagcatatcactgccggcgtaatttgcaaaggtaaatccgttgccggcgtccctccaggactcgtacgggctgacggtgtccttcagtccgccggtctcccggacgatgggcacggtgccgtaccgcatggcgatcatctgactcaagccgcagggctcgctcttggagggcatcaggaacagatccgcgcctgcatagatggccatggacagctcctcgttgtagtccaggcgcacggccatgcggccggaatactgctgggctgcccactggaagaactcctcgtacttccggtcccccttgcccaggatcaccatctgcaggggcagctccatcatgtcgtggagcacctcgcacaccagatccaggcccttgtgggacaccaggcggctgacgatgcccacgatgggaacgtagggctcctgccgcaggcccatgagcttctgcagctccgccttgtccgcctgcttgcccgccatgtccgccgcgctgtaattgacggcgatgtggggatccgcggcggggtcataccgcttcacgtcgatgccgttcagcacgccggagagcttgtagccgcaacggcgcatgatgccgtccagccggtgggcgaagtagggcatcttcagctcgttggcgtaagtaggagagacggcgttgacggcgtcggcgcacaaaatggcgcccttcagcaggttcacgtccccgtccatcagaatggtgccgtcatccgcccagccgtggtccaggccgaacaggtcccccagggtctggcggccgtagcggccctggtactcaatattatgaatggagagcacggtccggatactccggaaccgctcctcccgcacgctgtcgtccttcagatagatgggcaccagggcggtctgccagtcgttgcagtggatgacctccggccagaacctcaggtggggcagcatccgcaccacggcccgggagaaaaatccgaaccgctcgccgtcgtccatgtagccgtacaactccggacgccggaaatactgctcgttgtccaggaagtaccaggtgacgccgtcccgttccatggagaacagcccgcagtagctgtggcgccaggccaggtccacatagtcgtagcattcaaaatgcagctggtcgctgaatttctccttcaccttctggtacaggggcagcaccaccgccacatccgcgccctgggccgccagcgccgcaggcagggagcccgccacatccgcaaggcctccggttttgcagaacggaaccgcctcgctggccgcatataaaatcttcatagtcctctcctttcacgctcatgcgccccgccctccggcagggtcagggaccggcgggactccgtcagccggagccccgcccgtctattcgccgtcctggaagccttcctcccgcactcacacctgactgcccttggccagcacgatgggatacgagctgtgtcccatcagcgtccggtccggcaggatttctacatttttatccgcgatcagatgggacaccgccgcgccccggcgcaccgccgtctccttgaagagcacgcagttgcgcaccacagcgccggcctccaccaccacgccggggaagaggatggagttctccaccacgccctcgatgttgcagccgtctgcgatcagggagttctcgcagtagccgtcgggtccgatgtaggcggaggacttgtcagtggccttggcccggatgggccgctcggcacagaacagctccgcccggatggccgggtccagcagctgcatactgcggtcgtaatactcctgtacagagcggatctgcgccgcgaagccgccccagatgtatccctggagcttcaggctgtccttccgggcctggagcacgtcccgccgcaggctgtactgatcccgggtggcgcactcgtccaccagatccagcagcagcctggtggagaggatgtacacttccagcccccggtagcccctgggccggtggaggtgatacaacacatccgtgacgcggccggtgccgtccagctcaaaataggtgccgttctccgtctcaaagctgtcgttgccgcagactacggtgatgtccgcgccggacttgatgtgctggtcatagatgtcggacaggggcaggttcaccaccaggtcgccgtccataagcaccacatagtcccggcggatctcctccagataggagcggacgcccgccagggcctccatcttgccccggaagaccgccgcctcgccccagtgctgcttgtatgcaaaggggggcaggatcttcaagccgccccgcttgcgggacaggtcccagtccttgccggtgcccaagtggtccagcaggctctgataatggccgtgaagcaccacacccacgtccgtgacaccggcgttcaccaggttggacagggcgaagtccaccgcccggtacctcccgccgaaggggatggacgacgcggagcggatctcccccagctcccgcaggtcattgcgcttttcataggaaaagatgatcccgtgcatgccgttcatctggacacctcctcgccgttcttgttcagcatcacgccggggcgcacccgcttctcatcctccaggacgcagcccggcgccagcaccgtcaggccccagggatccggcgccgtctcctccggcgtgccgcccaggcagcagttgcggccgatgcggcagccctcgcccaggatagcgtattccaccacggcgccgggctccacggtcaccccggggaacaggacggagtaggacacccgggccccctcccccacggtgacattgggagccaggacggagttctccaccgtcccctccagatcgctgccccggttgaaggcactgtggctgatctggcagcggcggcccaaaaaggccggcggcgcgttgacggaccgggcgtaaatgggccaggactcgtccagcaggtccaggcccgactccggggagagcatatccatgttggcgtcccacagggactccagcgtccccacgtccttccagtaaccgctgaagcggtaggcggccatccgttctccatcccccagcatggcggggatcacatttttgccgaagtcattttcggagttggggttggcctcgtcagcctccagataccgccgcagggtcttccaggtgaagacgtagatgcccatggacgctagattgctcttgggctccttgggcttctctgcgaactccgtgatgaggtcgttctcgtccacgctcatgatgccgaagcgggacgcctccgaccacggcacctccatgacggagatcgtgcaggcggcgcccacggccttatggcgctccaccatcttggagtaatccatcttgtagatgtggtcgccggagaggatcaccacatactccgggtcatacaggttgatgaacccgatgttctgatagatggcgttggcggtgcccttgtaccaggtgccgcccttgctgcccatgtagggcggcaggatgtggacgccgccggtggacccgtccaggtcccaaggcacgccgctgccgatgtagctgttcaactccaggggccggtactgggtcagcacgcccacggtgtcgatgccggaattggtgcagttggacaggggaaagtcgatgatgcggtatttcccgccgaagggcacggcgggcttggccatgtcgccggtgaggacgtacaggcggctgccctggccgccggccagcagcatggcgatgcactcttttttcatgtcttttccaactcctttgcctgttgtttcttcctgggtctggggaacgtcccctcgccccgcaggaacaccgcaccgaaggccgggatccggatggcggcggagcattcctttccatgggagggcacggcctccaccatcaccgcctcagaatcgccgaaaccgtcgccgccgtatgcggggtcatcggtattgaacacgggcacataccgcctgtagggcggcacgcccatccgatagttcgtataggtgttgggcgagaagttcaccgcgcacataaggtcgcggcccttcttgtccctgcgcagaaacaccaccacgttgttgtggttgtcgtccggcaccagccattcaaagcccgcccagtcgaagtcgacctcccacaaagccgccgtctttttataaaaggcgttgatctcccggaagaacttccggagcttctgattctctggtcggtccagcaggtaccagtccagctgcccgtcggagtcccactcgtgccactggccgatctccgcccccataaacagcagcttcttccccgggtgggccaggagataggcgtagaagcctctcaggcaccgcagctggttgtcgtagtccccgggcatcttccccacgatggaccccttcatgtggaccacctcatcgtgggagatgggcagcacaaagttctcagaaaaggcatacatcatggagaaggtgatgtccttgtggttgtactggcggaaatagggatccagcttcaaatagtggcacatgtcgttcatccagcccatgttccacttcagattgaagcccaatccccccacgtccggcgggcgggtcaccaggggccaggcggtggactcctcggcgatcatcagcacgcttgggtccgtctggaaggccatggtgttcagctcccgcagaaactcgatggcctccaggttctcgtgtccaccgtactgattgggggtccaggctccgccctggcggtcgtagtccaggtacagcatggaggccaccgcgtccacccgcaggccgtcgatgtggtactcttccagccagaagcgggcggaggagaagagaaagctcttcacctcgggccggccgtagtcgaagacccgggtgccccaggcggcgtgctcccgcttgttgggatcgctgtactcatagcagtaggtgccgtcgaattcgtagaggccctgagcgtccttgcagaagtgggagggcacccagtccagcagcaccaggatgccgtttttatgcatgtggttcacgaaccacatgaagtccttgggcgtgccgaaccgggaggttggggcgaagtacccggtgcactggtagccccaggagtcgtccagggggtgctccgtcaccggcagcagttcgatggcggtgtagcccatatccttcacataggcggccagatccttcgccaggtccttgtagtcgatgaagtccccgtttccccgctttttccaggagcccagatggacctcatagatattcagcggtgatgtatagaccgggtgcttggccttcttctcccggaaagcgccgtccgtccacttgaatccgctgatgtcatacagcttgctggctgtcgccggccgggtctctgtgtggaagccgtaggggtccgccttctggcggacctggccgtccgccccccgcaccgcatatttataggaagtatagaccggcaggtccggcagaaagccctcccagatctcgcccttacgggcgaggggggccgctccctcctcccagtcgttgaagtcgcccacgacggacaccgcctccgcatggggggcccagacccggaacgtccagccatctctgccccgctttttggcagggtgggcgccgaaccagcgccagccgtccgtcatcgtcccctggtggaaacggtccgcctgtccttgttttgccatggcagcagctcctctccccgccgcggagtatccccggcaggctcgtcattcttagagtaaagcgtttgcgcggaatctggatatgcatataattgtttatattatacttcctgggaaaaataccgtcaaggatggtcctgtcgaaaaagggcggcacaagttggtgggatttcccagttttttcccgtattttcacaagaatgtttggtgctttttgtgggattggtcaggatttttcccggaactttccgctttttaatctcgtctgaacagaggaaaaattttccgcccgtgttgggcggaacggaaaggaagaatcccatgaaatcccgctctctgttctgtgcggcactggccgtgctgctgctcctgctctccgcctgcggtcatccggcaccagaggccagcggagccgcagcggaagggctctccgccacggacaccatcacgccggaggaaggcgtcgccattctggaaaagcaactgggcgcagtggacgaggccaccggcaatgtgatgtcctacggctacgaagggccgcttactctggacggagtggactattacaactaccgggtctcctggctggtggacggcgatcacctgtcctatctcaccaactatctggtatccaccgacgggctggtggtccaggagtacctgccggagacggattgattgccaaatgaaaccacccgccgggcctgcatagccaaacaaatcctgcggatactagcttttgccaagcagaatcatcctgaaaaatctgaaagacaaaaggagttttcgatatgaaggcaactggaatcgtgcggcggatcgacgacctgggccgggtggtaatccccaaggagatccggcgcaccatgcggatccgggagggcgatccattggaaatctacaccagccgcgagggtgaggtcatcttcaagaaatactcgctgctgggcggtgtggaggacttcgccgcggagctctgcgagaccatgagccggtccaccggcagcgtctgcgccgtcacggaccgggacacggtcatcgccgtggcgggcggcagcaagcgggagcttatgggcaagcggatcaccccggagctggagcagatcatggagagtcggaaaatctaccagtacaccggcgagggccagcccctccaggtgacggagggcatcgacagcctgctgaccaccgtggcggcccccatcctggcggagggcgacctgctgggcctggtgctgttcatctccagcgatcccgctgccgtcaccggcgacaccgagtacaagctggcccagaccatcgccgcctttctgggccggcacatggagagctgaatcctctctcccgcgcggacgcctgtacaggcgtccgcgtttttgatggcatgaaatgccggaaagacgctatgctggaagtatcccccaattcggaaggagctgcttccatgacagtttcagagtggatcgcgtatgtggaccagcgggtctggggcccgggaatgctggtgctgctgatgggcaccggcgtcttcctcaccctgcgcacccgctttctcccctggcggaacctgggctgggcgctgaaaagtgttctcggccgtgactcccgcgccaaggcaggcggggccggcgatgtgtcccccttctccgccctgatgaccacgctggccgccaccatcggtaccggaaacatcgtgggcgtggccacggccttggtggcgggcggccccggcgccttggtgtggatggagatctccgccctcttcggcctttcctccaagtgcgcggagtgcctgctggccgtcaagtaccgccagcgggacgccggcggcgaaatgcgcggcggccccatgtataccatgtgcgccgccctgcggtggaagcggctgggaggtgccctggcctttctcttcgccctcttcacagttctggcctccctgggcatgggggacatggcccaggccaattccatcgccggggcgctggccgacagcttctccgttccggcccggaccaccggggtggcagtggctctgctggctctcgtggtcattctgggcggtatccggcggattgccggagtctgctccgtggtggtgcccctcatggcggtcctttacctgctggcgggcaccgcagtgctgctggggcatctgtccgctctgcccggagccgtggcagagatgttccgcctggccttctctcccgccgccgctgcgggtggcgcggcggggactatgaccgcctccgccctgaacgccgctcgctggggcattgccagaggctgcttttcccacgaggcgggcatgggctccgccgccatccctgctgcctccgccgccacagacagccccgcccgccaggggtatgtgaacatgaccggcgtattcttcgacaccacagtgatctgcacagtcacgggcctgtgcatctgcgcctccggcgtgctggggactgccgacgcttccggcgggcaggtaaacggcgtggccctcaccgccctggcctttaagaccgtgctgggccccctgggggggctgctggtctccctggggatcgtgctgttcgccttctccaccatcctgggatgggagttctgcggggaaacggcctttgcatttctcttcggccgccgggccatccctctctatcgaattctcttcgccctggcggcctttctgggcgccactcagagcctggaggtggtatggaatctctccgacatcttcaacgccctgatggcagtgcccaacctgatctccctgctcctcctctccggcaccgccgcccgggagctggaggccttccagccggagatccgccgcgggcggagactccggcagaggcgggccgtccggcgggcactctgagtccgctttcttcaggtgccaccgacgggggccgcctgcccctgccggcatgtccgggaccgtgtgcaggtccgtctccccattcggatgggaaatggcggaattcgtgaatttttttctggaggagttgcttttttccagtttgatggtaagataaagtacggtaaaaattttaaacaaaggacttgataccatgaccaaaattgatattgtctccggcttccttggcgccggcaagaccactcttatcaaaaagttgctggcggaggcctttcccggcgaaaagctggtgctgatcgagaacgagttcggcgagatcagcattgacggcggctttctgaaggagtccggcgtgcagatcagcgagatgtccgccgggtgcatctgctgctccctggtgggggacttccacaaggcgttgaaggacgtgcaggctcagttccacccggaccgcatcctcatcgagccctccggcgtgggcaagctgtccgacgtgatcgtggcggtgcagaacaccgccgatgagaccgacgacatgaagctgaacagcttcgtcaccgtggcggacgccaccaaggtgaaggtctacatgaagaacttcggcgagttctacaacaaccagatcgaggccgccggcaccatcatcctctcccggacccagaagatgagccaggagaagctggaggccgccgtggccatgctgcgggagaagaacgccgacgccgccatcctcaccaccccctgggaccagctggacggcaagaccatcctggcggccattgaaaaggtgtccctggcggacgagctgctggggaagatgcgcgccgagcacgccgccgatgaggcggagcacgagcatgcgcatcaccaccatgaccacgagcatgcgcatgaggagcacgaacaccatcacgatcatgaccatcacgaccacgaggagcatgaccaccatcacgatcacgatgaacacgcgcatcaccatgaccacgaccacgagtgcgacgatcccaactgctcctgccaccaccatcaccaccacgccgacgaggtgttcacctcctggggcaaagagacccccaaggtgtttgcccaggcggacattgagcggatcctcacggccctggactccggcgactacggcaagatcctgcgggccaagggcatcgtgaacggcgagggcggcaagtggatcgagttcgacttcgtccccgaggagcatgaggtccgggcaggccatcccgactacaccggccggctgtgtgtcatcggcgccgagctgcaggaggacaagctctcccagctcttcggtctgtgaactcttttcttgaaagactgtaaccacacttgatattgctgcacaaaatcaagtggagtccgtccccgaagtagggaaaagagccaaaagagcttcagcgcgccgcggtggccggtgtgagggactgtcagagtcgaaagtcagatttcctgctgtccgggcgcccgttccgcgtattttacccgaaaggaaatgcacattataatggcagacattcctgtttatctggtggccggctttctggatgccggcaagaccaatttcatcaacggcatcctggaggacggcttcgcccgccaggatcccaccctgctgctctgctgcgaagagggcgaggaggagtacgagaaaaacgctttggacaacgtgacggtcatcaccattgaggacgaggaggacctgaagtgctcctacctgaaggagctggagaaagagtaccaccccaaacaggtgctgatcgagtacaacggcatgtggcagatggagcggctgtaccgggaggttctgcccgccaactgggtgctgtaccagatcatgaccttcgtctacgcccccacctttgagatgtacgccaagaatatgggccagctgatgatggagaaaatcaccaacgcggacatgctggtgttcaaccgctgtacgccggagctgcgggacgccctgcggaagcggaaccttcggatggtgaaccgtcgggctgacatttacctggagatggaggacggcaccagcgaggactacctcaccggcgacgagtgccccttcgacctgagccaggacctgatcgacgtgccggacgacgacttcggtgtgtggtatgtggacgtgatggatcacccggaccgctgggcgggcaagatggtccacatgaagcttatcatgtgccactccaagaagtacccgggcatccactgccccggccgctttgtcatgacctgctgtgagaacgacatccagttcatgggtctcatcgccaagggcatgaacctgaaccagtaccagaaccgggactgggtggaggtcaccggccggatggcggtggagaagcacgccgcttacaagggcaaggggccggtgatgcatgtgatctccatcgggccctgtgagaagccccagcaagaagtcgtgacgttctaagaggggagcgggctcccctcctaaccaccctaccaccagtctgcggactggtgtgtgcccaaggcgcacggatcaacgtattttcggcaggcgcatgtcctgccgaaaatggatccgaatttcttcgaaattcgatacggggtgtataaccttgctgcaaaaatcccctccgttgttgaacggaggggatttttgtcttatgcgagaccaagcgcccaaggattctcatcgggcaggccccggcccgtctcccagcggctcacggccttgtccgtcacgtggagccgttccgtcagttccccctggctccagttcttctcttttcggcgccgggcgatcagcccgccggtggcttttgcgtccatgccatccgctccttttccagccatatcataccacaaaactgtctcaaaggcactctacacttcgcaggagccttgcttttttccggaaaatccttataatggaggtattctgtgtgtgtggaaatccaaccagaaaggaccgtctgctcttgaagctccatgaccattttcccaaagtccgactgcccctgtgggccacgcttctggccgctgtgctgctggcgggcgccatcactctgctggcgctctggtgccagcccaatgccctgcggagcgtcctggccgtcttccgggcgcagccgctgctgattatcctgaactgcctgccggtggggatgctgctgctggtgttcacctgcctgctccggaacgtgttcttcgccggggcgctggcgaacttcgccgtctgcgccctgtctatcgccaaccgcatcaagatcgaggtacgggacgagccggtgtttccccgggactttgccctgctgaaagaagcgggcagcgctgtggggacttacgacatccagttcccggtgccgtccatcgccgccgtcgtggtgttctcgctggtgctggtggccctggggcttttcgtaggcagccgccccttccccatcgcccggctccgcggctgggtgggaagcctgctgggggctgccgccagctttgccgtgctggcaggactgatcctgacagtctatgcctccaatgatctgtacaactccttccgggtatccaacgcctactatattccctccgtgttcaacgagctggggttcccctactgcttctgccaccagttcaccacctacccggtggacaagcctgagggcttcagtcggtcggaggcggccggctgggaccagggcggcgacaccggtctggggaaggatgtgaacgtcattatggtgatggatgaggccttctccgatatcacggacagcgacgctttcgctttcacagcggagaacgaccccctgcccaacctccacgccctgcgggaggatccccacgccgtcgccggccatatcgtggtgcccggcttcgccggcggcactgccaacacggaattcgacgtgctgacaggcatgcagaccaacgcgctcgctgccggaacgacctcctccttccgggtggtaaaccggaacctggacagcctcttccgggtgtttggcggcgatggctaccacacctccttcttccacccgggggacgactggttttacaaccgggagaacgtctaccgctggttcggggcggaggagaccgtatttgctgaccagatggaggcgcttgcatacaagggccgctgggtcacggatgactacatggcgggcctgattgaacaggaattcgcggacactgtggccgctggcgagacgctgttccactacacaaccaccattcagaaccacatgtcctacaccctggacaagtacggcgagagctatgcctatccggaggtgccgctgaacacggcggtgtccgacgaggtggagacgctgctgagagtctacaccgaaggggctcgggacgcggacgccatgctgggccgcctggtggacaccttctccgccgtggaggagccggtggtgctggtgttcttcggagaccatctgccctatctgggcgacaaccagctggcctacgcggaactgggcttcacggcccggccggagtgggacgcactgacctcctacgagacgccctatgtgatctgggccaatgacgccgccgcgcaggccctggactgggaggccgccgtagcgtccctggacctgccggaggatgggcggctctccgccagcttcctgggggccgcggtgctggagctcaccgggcggaccggggagagcccctggttcgactttctgaaccagctgcgccgggagctgcctgtggtgcagaagcaggcgtatcagctggcagacggcacagtgacggaccagctgacggaggaacaggcggcgaagatcgccaaatggcgtcagtggagctactacaagctgatgtataaggagatcgactgaaaacggcccccggtggacagtgtccgccgggggccgttcttttcttgacaggtctgactgcccttgatacaatggagaaaagccccatcttttgaaaggatgtgcgccccatgaagtcctggtctcaacgggaactggcgctggctgtgctggtggtctttgccgcaccggctatcccctatgtcacctcccgcttgctgggggatttgtcgtctcttttccttgggacagttcctctcatagggacgctcttgtctctgttcctctacgcttgtatctctgccctggtgacggggggccgttttttctctgggcccggagaggccgccggatctggccctgggtcttggctctggcggtctgcctgggtctattccgtcttttgtgtatagacataaatgccactaacaatctgctggcacttgttactggctatcacaacaatgagtccaccgctttccacctgctctacctacgggtatgctacagcggaatgctgtttggggtggccttggcggccattgtcgcctggttccttcgcaaaatcaactcctgacaagaaagccgcccggagccgttggctccgggcggttcggtgtggagctcccgcccctgatggatcgggacattggccggcccatggaaagctaggccgtgtggaattccggcccggaatcccgtgctcctttgcctacatcccctccagcggttgcagctccgttccttccgggaaggccccggcataggagacgcctaccgcatccagcagctccagccgcatccggcagaaactcccgccgccggtgatgcagaacacgttttccccctgccgcagcgtcaccggccagttgctccagatggcgccgtatgcctcctccgatgccccctgcagttcccaggactccccaccggccagacacaccgtcaccggctggtcctgggaggcataggtgcagttcaccgtggtcgtgcaatcctcctccacggcgacatagagaaacgccgccggttcctgccgggtggtcagggagaattctgccgtgatcggatcatcggcaaccgtcagggtttcaaactgcggccctgccggggtctcggcggtctctttccgttctgtctctggaaacgccgacagatcctccggaatatcttccaggcggccgcaagccgccatgagaaagcagcagatcaggatcaaaacacagtgttccttcttcatgaaaataccagtcctttcctcacgctctgtttatcaaacgaaatggctgcatccttttcctcatctcccgcaaaaaagccagcggctgtgccgctggctttcagacgttctcgtttttcgggtgaaaatgttcccacaccgcctgggcggcggcccggggcaccacggcggcaagggtctccacatccgcctcccggatggccttgatggtgccgaagtgtttccgcagctccgcccgccgcttctcgcccacaccggggataccgtccagggcggagcgggtggcgcttttgctgtggctctcgtggtggtaggtgatggcaaagcggtgggtctcctcctggatctggccgatgagggagaacaccgcctgctgggtgacgatgccgatctcccggccctccggcgtcaccagggcccgggttcggtggcggtcatccttcaccatgccgaagatgggcacatccacaccgaattcccaggccaccgtctgcgctgcccgggcgtgggtctcgccgccgtcgatcagaaacacgtccggcaggggcagaaacttctcgtccccatccgctgcccgctggagccgtcggcgcagcacctcctgcacggaggcgtagtcatccggatgtccctccaaagactggatgcggaaacggcggtaggcggacttcagcggccgggtgccgctgtataccaccatggaggccacgatgtcgctctttcccgtgttggagatgtcgaaggactccatccgcttcggaggctccggcagattcagcatcttccccagcagctccagggtgtaggcagtccgctcctccacggtggtggctcgctctgtctcctcctgggcgttccgctgggccatggcccgcagctccgccttctctccccgctggggcacgtggacccataccttgtggcccgcccgcttcgtcaggacctccgacagctcttcgcagtcctccgtctccatgggcagcaggatctcgtggggcaggatggcccggggaaggtagtactgggccgtcagggcggagagcatctcggcctccgactcctcgttgggggcggagaacagctccgtctcccggccggccagatttccctcctccatgtggagaatggcgtaacagctcttgccggatccccggtacagtccccagatgtccgtatcggcacagaggcccgcgatcaccgtctgctttttgctgagggcaccgatggcgttaatccggtcccggagcagcgccgcctgctcgaagtggagggcctccgcctccgcctccatctcggcggtcatgtcccggagcagctgcttgctcctcccctccagcagctgcaccgcctgctcgatccggcggttatacgcttctgctgtcatctccggccggcagaatccgtcgcaccggcccatgtggaagttcagacaggggcgctctgccccgatatcccgtgggaatttccggctgcaggtaggcaaccgcagggccacacacaccgcgtccagggcctggcgggtctcgaaccgaccgccgaagggcccaaagtaccgggcggagtcattggccatcttgttcaccagggagaagcgggggtatgcctctttggacaggcggacgaaggggtaccccttgtcgtccttcagcaggatgttgtagcggggcatgtgccgcttgataagggagttctccagcaccagggcctcgaactcgctggtgacgaagatggtgtcgaagcggtccacctgagacaccatgttccgcgtcttggcggtgtgggaggcgctgtcctggaaatactggctcacccggtttttcagcttcttggccttgcccacgtagatgaccctgcctgttttatccatcatcaaatagacgcccggcaccagtggcaggtcgttggccttctcccgcagctcttcctttgtcacgcccgccgcctcctcgcataaaagatacacggccttgcgcgccgcagggccgtgtcgtacttcctgtatcgaatgtgttattcgccgaagttgtccttgaccagttccaccaacgcctcgacagcctctttctcatcggcgccgtcggcgatcaacgtaatggtggtgcccttcacgatgcccagggacagaacgcccagcaggctcttggcattgacgcggcgatcctccttttcaacccagatgccgctcttgaactcatttgctttctggataaagaacgtggccggtcttgcgtgcagacctacctcattatttacggtgatctcctgtgtatacatgatccagctctccttttctataccaagtcaaccaagtctgttccaacagctccacatgataaccgatgatttttctgataacatcatacccggttttacacagacagtcaacggcgtttttcacaaacattttaaaatttccaggaaaccgtacacagtcttttcgtcttttagcctatctttcacaattttccggcagttaccccctcttttttatctatttctacaagggcggctggagacgcagacaggggacctcccaaaaggaggtcccctgtggacagtgggatcaatagttctcggccttcacctggaagtaggcctgggggtgcttgcacaccgggcacaccgccggcgcgctctcggcgatctccacatggccgcagttgcggcagaaccacatgaccttctcgcccttcttgaagacctcgcccttcttcaggttgtccagcagctttaagtacctctcctcgtgggtcttctcgatcttggccacgccctcgaactgggcggccagcgccaggaagccctcctcctcggcggtcttcgccatctcggcgtacatcttggtccattcctcgttctcgcctgcagcggcagccaccaggttctcctcagtgctgccgatgccgtccagggccttgaaccacagcttggcgtgctccttctcattcagagcggtttcctggaagatggccgcgatctgctcgtagccctctttcttggccttgctggcaaaatagtcgtacttgttccgggcctgggactccccggcgaacgcgatccacagattggcttccgtcttgctgcccttcagttccatgtgtctgactcctttcaaattttacaattgtctcttttttcctctggtctatactcatgccggccgtcctgtcccgcacagcgcgggcagtgtccggtgaatatcagggtgtggcccgtgaccacgcagccccgggccgcagccagacggtccagcctctcgtcatagggcacagtctccagatccagcacagccccgcaggcgcggcagcggaaatgggtatggggccgagtcaccgcgtcaaagcgggtcacagggccgtccagctctgtcaaccgcccctcccgggccatctgctggagattgcggtacacggtccccaggctcagccggggcatctccggcttcagctgctgatagaccatctccgccgtgggatgggcgcggctctccagcacagtctggtagatccgctcccgctgctgggaaaaacgctgcggcataggctttcttccttaaatagtaataattactattatttatatatcatatcctgctggaaaatgcaagcactttttcaaaattcggacaacattcgactgtccggcgctggcggaaacttccgctgctaaatccagacgccacggagacaataacacctgggtatcgcgaaacaaacgcccgcgcaaagggaggtcaacccatgaaaagacagtttacgctcttgctggcctctgtcctggtggtgtttgccctgaccgcctgcggcggcaacgacaaagacaccaaccaagataacaacggccaaaacacggtcggagaggatatccagaacgctggcgaagacatcatggatgccggcgaggacatcctggaccccgacaacaacaatagcaacaaggacaacgggaccggcgatcacaagaacgaccagaacaccaccgacagaggtgacagtgccctcaccggcggcgacaccaccgtggaggatgccgtcaccaagcagaacagccgtcccggcgtatcctacggacaaatgctgcgcaatgcccgggtccacgattccgacgggcttctgacggaccacgaaaatgccgccagcggccgcacagcataaaaacggacagagaagcgttttgcctgcttgaacaggaagacggcgcgcagaaaacacacagggccgcggcaacagctgcggccctgtctttttccgaaagggcttgggaaggtccttgccttttccagggaacatggtacaataaggcaaagcatacattttgtggaaaaggagccgctatgagcactgtgaaagaacccctccaccccctgaggacagcccggtacctgtggctgggcatccttctctgcgccctggtgggcggcgcctgctttctgggcgggcggtggtccgccggccggtctgagacagcgaaaatagacacggtcgtcctgcagaatcagctgtcggagatccgggagctggccacggtcacctacgcctacaccaacatggcccagttcgagagcagcaacgacttctacggggtgaaaatccccttcaccaccaagtccttcatccttacctacgacggcaccgtcaaggccggggtggacctggacggggcggaggtgtccgtcagcggcaccacggtcaccatcacactgccggaggcggagatcctctcccacgagatcgatgaggacagcatggaggtgttcgacgagaagacctccatcttcaatcccttcacagtggaggatttcacctccttccagtcggatcagaaggcagccatggaggaaaaggccctgtcccgcgggcttctggcggaggctcgcgccaaagccgtctccagcgtagagcagctgtttgccgccgcactgccggacacatacaccgtcacggtccaataaaaaacagaggcggagccgcggctccgcctcttctcatgccaggatatagtccccagggcctccggcgtgtccgccagatggtccgccccggcgtcctccagctcctgccggctccgaaatccccaggtgacgccgcaggccgtcaggccgccgttgtgggccgtttgcatatccacgccgctgtctcccacaaacaacgtctcctccgggcgcactgccaggtcggccagcagagcgtggatgcccgccgggtccggcttcaccggcactcccttgacttggccccgcaccagatggaagacaccgggaaagtagtgttccacgatctcccggcaaaagccgtccgccttgttggagtaaaccgccagggtcactccccgtctccccagccgctccagcagtgccgggatgccgtcatagggccgtgtctcgtccatgttgtgggcgccgtaataggcggaaaactgggcgagagtattggccagcagcaggggactgcggctcttctccggagaaaaccgccgcaccagattggggattccatggcccaccatggtcttgaactcctctgcggagtactccggccagccgttccggcggcagacccagtttccggcattggtcaggtcctgaatcgtgtccagcagggtgccgtccaggtcaaagatcactgtatgatacatggcccgtctcctttgttcttcggtaagattgtttttattttatcaatttctccgcaccgctacaactggcattcaaaccgaaaggcgcggttttcaccgcgccttttttatgaaagtttcccgtcatttcacagggggcagggcttccaacccctcccggtcagcagaacacattcccggaaacccgccgctcttgccagctccgccgcctggccgtagccgtacacgaccgtttccgggctgtgggcgtcggcggtgaggatgatctgtcctcccatgccccgccactcccgcagaaggaacaccgccggatagggcgtgtcccggtatccccgggagatggcgccggtgttgacctccagcagcgtggcatccgggtccgtgtggtgcagggcctccagcgccgccgtgcggcagcggggatcgtcctcgtcaaacagggcatttccccgattcagcttggtcaccaggtcaatgtggcccagaatggcgggtcttcggtccgccatggcggctacatcccggtagtagccctctgtcagggccagcatatcgccgccgaacatctggtcccggcaggcgatcagccgctcccggtcccagtctatgccatggtacttcccggtcttcgggtcatagaggttgtggacggagccgatccagtagtccgcccagtccggaaccggctgtgcggaccggctgtcctgctcgatacccagcaggacctccatctgtccggcgtattcctcccggaggcgtagcacctgctcccggtattccgccggatcggttggcaggacgttgcccgcgtcgtgggggatctccgtgtggctgtggccggaggcgccgaagaagcggacccctgccgcatacgcggccgcagccatctccgccagggttcccttcccgtcgcagagaacggagtgggtgtggacggagcagcattccggtgtcagattcattgcatccgctcctgcttcaccttgtggtcgatgacatggcgcttctccaactccgccatcacgtcctccagggtgatgcccatctggaccatcagcaccatcacatggtaggtcaggtcggcgatctcatagatggtctcctccctgtcctccttgcggccgccgatgatgacctcggtgcactcctcacccaccttcttcaggatcttgtccaggcccttttcaaaaagataagtggtgtagctgccctccttgggatcggtcttccgcccttggatcaagcggtacaggccctcatagctgaaagccttcaactcctcggagaggtagaccggccggaagaagcagctctccgccccggtgtggcaggcggggccgtccttcaccacctccaccaccagggcgtccttgtcacagtccgcggtgatggacaccacatgctggacgttgccggaggtctcccccttgcgccagagctgctggcggctgcgggagaagaagcaggtccggccctcgtcaatggtgatggccaggctctctgcgttcatgtaggccagggtcaggacctccttggtgtagtggtcctggacgatggcggggatcaggccgtttgcgtcaaatttcaaatccatggtgctgtctccttttcttgggtatgccgcccgtgggcggctgggactccgcttcccgtccgggaccgggcgttctgtcagatccgcatctccacgccttgcgcccgcagatagtgcttcagctccttgatatccacctgccgggtgtggaagatggacgccgccagccccgcatcgatgccggggtgggtgaagagctgggcaaagtcctccattttcccggcgccgccgctggcgatgatgggcacgctcacccgtgatgccagggcgtccagcatctccaggtcaaagccctgcttgacgccgtcggtgtcgatggagttcaacacgatctccccggcgccgtcggccacgccccgggcggcccactccatagcgtcgatgccggtgtcctcccggccgcccttggcgaagaggcggaactgcccgtccacccgcttcacgtccatactgagcaccacgcactggtcgccgtacttcttggctgccgcgccgatgatggtggggtccgcgatggcgccggagttgacgctcaccttgtcggcgccgcatttcaagacccggtcaaagtcctccagcgtccggatgccgccccctaccgtcaggggaatgaaaatctcgcccgcaacccgccgcaggatgtccgtaaacaggttccggccctccgcagaggcggtgatgtcatagaataccagctcgtccgccccggattcgttgtagaaccgggccatctccaccgggtctgccatatcccgcagaccctcaaagttggtccccttcaccacccggccgtccttcacgtccaggcaggggatgatccgcctggctaacatgcgcccacctcccggatgaccgtttttaaatccagacggcccgtgtacagggccttgcccagaatggcggctttggccccgatcttccggagctcccgcagctcctccagactgctgacgccgccggaggcggtgatgtccaggccctcaatttttgccagctcccggtagagcgccagattggtgccctgttccgccccatcccggctgatgtccgtatagatgacggtctggacgcccgcgtcccggaggcggcggcaaaagtccacgcccttttccgcagacagctccttccagccgctgacggccacgtagccgtcccgggcgtccacccccacggcgatccggtcgccgtatgtttgggccatccgctccgtgaagtcgaaatccttcaccgcgatggtgcccaggatgcaccggcccacacccagatccaggtaccggcggatgcggtcctcgtcccggattccgccgcccacctcgatgtagaggccaccctgtccggcaatggcggcgatggtgtcaaagttggccagggtgccgtccttggcgccgtccaggtccaccacatggaggtatccggcaccggcagcgatgaagtcccgggccacggcgcaggggtcctgggcgtagaccgtctctttgtcatagtctccctgatacaggcggaccacctgtccgccccgcaggtcaatggcgggaaaaatctgcatagaccacgtctcctctgtcaatctttgttcttgttgtccagaagcaccagcaccagaccgatgatcccacagagcagacccaccggggcccaataggcccgcatccaactaagaatcgtgagcgcagggggctcaaatccgaccaataccagcagaatgccgaacaggatccaggcaaaacccagccagatccgcctcatgccgtctcctcccaatctaattataggtgctccttgcaggagagctcctccgcatccagccgcaggacgcacacggcgtccaccgccgcgtccggaaaggtccagtccccgcagcaggtagcctggcgcatgatagccgccagaccccgccgcctctcttccgccgtctctaccacacggatggggccctcgccgatgacgctttgaaacgcggcggtgtagccgcaggccgcctccgcccctgaagccggtagccggtgtccagctcgaacccggcccagccgtttcggcggaccaggtccaccttccgcccctccgcggcgccgtggaagtaaaagacatggcggccgccctccaccgtgtggccgaagttcaccggcaccacgtagacgcctctgccgtcctgaaggcccaggcggcagacttcacatgcgtcgataaccgcccggaccttctccggagccgtgacggccctgtcctgtcgtctcataggtctcatggcatcctccctcacagttctgcaaaggcccgcagcaaccgcagtcccgtgtccccggatttctccgggtggaactgggtgccgtagacgtttccccggcgcaccacaccggtgacatccacattgccgtaccgggacgcggccagagtgccggcggcgcagtcccgggcatagaagctgtggacgtaatacacatactctccgtcccggacgtggcggaacagggggtcatctttcaaaatctgcaagctgttccagcccatgtgggggaccttcagcgtcttgtccgtcaggtcccggcggaggtccactacttggccgggcaccagccccaggccggggtgctccccgtactcaaagctcttgtcaaacagcagctgcatccccaggcagatgcccaggagaggcttcttctccgcctcctcctgaatcaccggcaccaagccggtggcatccagcttggcgcgggcgtccccaaaggcgcccacgccgggcaggatgatccggtctgccgcccggaggcggccggcgtcgccggtgacctccgcctccaggtccagggccctcaggctggagagcagagagaacaagttccccacgccgtagtctacaattgcaatcatttacagcacacccttcgtgctgggaatttcatcccggtgtttttcgtccggggccacagccatcttcaaggcccggcccgcgcccttgaacacggcctccagaatgtggtgggtgttctccccggccatctgccggatgtggagggacatggggcacgcccggacgaaggccaggaagaactccttgcccagctccgtatcgaagtcccccaccctttgggcgggcaggtccacggaccagcccagatagtcccggccggaaaggtcgcaggccaccagcaccagcgtctcgtccatgggcaggaggaactggccgtagcgcgtgataccccgcttgtcccccagagcctctgcaaaggcccggcccaggcagatgccgatgtcctccacgctgtggtggccgtccacctgggtgtccccctggcagcggatggtcaggtcaaaatccccatgccgggcgaacagctccagcatgtggtccaggaaccccacgccggtggcgatgtccgccttcccagtgccgtccaggtttaaagagagctggatccgggtctcccgggtgtcccgcctgatatcagcagtgcgcatctctccgcctccttacagctcttccaggatggccgtcagctcctccaccagggtctccatctgctccatggatccgatggtaatgcggatatagtcccggatccggtccgcgtcgaaccagcggaccaggacgccgttctccttcagcttccggtacagggtctcgccgggaagctggctgtggcgggcaaagacgaagttggcctgggagggcaggacagtgaaacccaaattctccagctctcccacggtccaggcccgggtctgccggatggcagcggtgcaggcggcgaagtacgcctcgtccgccacagcggcggcccctgccgcgatggacagccggtttacattgtagggatggaagctgtatttcacccggttcaggtccgcgatcaactccgggctgcccaatgcgtagcccacccgaccgccggccagggaccggctcttggacatagtctgggtcaccagcaggttgtcataacggtagatcatgggcacgcagctctcggcgccgaagtccacatacgcctcgtccacgatcaccactcggtctgggttcgcctccagcagccgctggatgtcgttccggggcacggcaataccggtgggggcattggggttggcgatgacaatggtgccggggaaatccatatagtcgtccacatgtaaggtgaagtcctcccgcagggggattatcttcacatccagatcgaacagggcagcctgggacttatagaacccataggtaacatccgcaaaggccacgggttgccccgctccgcagaaggcccggaaggcaaaggccagcacctcgtcagagccgttgcccgccagcacgttcttggctttcagctcatagcgcctggcgatggcctccgtcagcgcggcacaggtggggtcggagtacaggttcagtttcaggatctccgcccggttgatggccttgagaaccttgggcgacggggggaaggggctctcattggtgttcagctttacatactgctgatcctggggctgctcgccgggggtgtagggggcaaggcgctccgcctcctgggaaatccagcggctcatgggatcactctcctttctcttccgtgcgggacagggcagaccgggcgtggccgtggaggccctcccgctctgcaaagtccgcgatccggggggcggcgtctgccagcgcctcccgggtgtagtagatgaactgggtcttcttcacaaagtcgtctacgctgaggggactggaaaaccgggccgtaccgctggtgggcagggtgtggttgggacccgcgaaatagtcccccagcgcctctggcgtgtggcggcccagaaaaacgctgccggcgtttttgaccaggggcagcagggcaaagggatcgtccacgcacaactccagatgctccggagcgatgcggttggcggcctccactgccgcggccaggtcctttgtcaccaggatcttaccgttggcctccaaggacttttgagcgatatctcgccggggcaggtccgtcagctggcgctccacctcgttttggacggcctccgccagggggcggctgtccgtcaccagcacggcggcggcgtgggcgtcgtgctccgcctggctcaacaggtccgccgccacccaggcggggtcgctcttcccgtccgccaccaccaggatctcactggggccggcgatcatgtcgatgtccacctgtccgaacaccttccgcttggcggcagccacaaagacgccgccgggacccacgatcttgtccacctgggggactgtctccgtgccgtaggccagggccgccaccgcctgggcgccgccgatcttgaacacccggtccgccccggcgatttttaccgctgccagagcttctgcagagatggcgccgttttggttcggcggcgtcaccaccgcgatctcttttaccccggcgatcctggcagggatgacgttcatcaaaatggtggagggaaaagccaccgggctgccgggtacgcagatgcccacccgctcgacaggcgtgtatcgctggcccagcaccacgccgggccggtccgtcaggcagaagtcccggtggacctgtgcctcatggaagtgccggatattgtccgccgcctgccgcagcgtctcccggaaattcccgtccacacagtcccaggcggcgcgcagctcctccgccgtcacctcaaaccgctccagatctgcgccgtcgaaccggcgggtgtattcccgcagggcctcatcccccgggtgcggacgtccgccagaatggcggccaccgccgcatccacatcctcctccgcctgggggggcggtcaaagaggggcaggtcctccaggcggtccgcctcatagatgggaatcatgcctccgtcacctccttcagcctgcccagaagcgcctcgatctcctggtgcttgaactggtagctggcccggttggcgatgaagcgggccgagatgggcatgaactccgtcagcaccttcagatcgttctcccgcagggtggtgcccgtctccacgatgtccacaatcacatcagagaggcccaggatgggggccagctcaatggagccgttcagctggatgatgtcgatgtcccggccctgggcggcgtagtaccgcttggcgatattcccgaatttggtggccacccgcagggcccggctctggtcctcggtaaagtctttcggcccggccacgcacatgcggcacctgcccaagcccgtgtccagcagctcatacacatccgcgccggactcggccaggatgtccttgcctacgatgccgatgtccgccgcgccgtgctccacgtagatggccacgtcgctgggcttcaccaagaagtagcggatgcccgcctttcggttctccaccaccagcttccgggtgtcggcgtagttttccgggcagccgtagcccacgcccgccagcaggtcgtaaaccttgtctcccaggcggcccttgggcagggccacgttcagcatcaccaggccagccggctccgccgccgcgtcggacagccggtccagctcgtctaagtacagcgcaaagccgatggcccgggcgccggggcggaactgctccgccagggggtcatactgcccgccccggagcactgcccggggcgctcccgccagatatccctggagcaccaagccgttgtaatactccatatcgttcaccagggagaagtccagcttccagtggtccgtctgcccctggtcctccagcgcccgacacaggccccgcagctcttccagcgccgcccccatggcggcgttcagggccagcacctccgcggcagcaagaacctcctgccagggccctgccagagtccccaggcggcagagtgcgtccgtcccctggcgggagaggcccgcggcctcagcggctttgcgcagctcatggacgtttttgtcccggatgcaggtgaggagcctgggccgcacagcctcctgggcgcccaccgcgtcaaagaggccggtgacgaagcccatgtggctgatctccagcacgaagtcccgcccggtcagggccaggctccgcagggccagggacaccacctgggccgcagcggcatcatccacggcaccgatgcactccaggcccatctgactgatctcccggaaggtatggctctcctggctggggcggtagacgttttcctgatagtagtaccggccgcagccgccgggccccacctgggcattcttggcgatggagagggtcacgtccggcttcagcgccagcagccgcccgtccaggtccgtaaaggtgatgacctgctcgctggaaagaaaacggcggttctcctgatagagaccgtattcctcgaaccgacccatgtggtatttgcggaagccctcctgttcatacagcagccgcagctgcagcgatgcccgctcctggggccgcaggacgttcagatccagttccatggggactctcctcccggcggactatcagcccgcgttgatttcagcatttattttactttattttattagcaaagtaaagcggtaattcggtagtaagaaaaattctatgcttttaacaaattcaacttcgcacaaaacagaagttaacgtgattttacacccaggatggtgtttttgcaatctccctttcccctgttcccgccctgacatttccagccctaaaaatgaaattttcttcatagatagaggatttccgacaaatgctccttttatcatttaaagaaaacccatgattctatggagtatggcaatgaaaagaagtacccctctgacccgcaacatcggcgcgaaagtgaaatactaccggaagctccgcggcctttcccagaagcagctggccgcccagctgcagaccaacggctgcgatatcacggagaccatgctgggccacatcgagacgggctaccgctccacttccatttttgagatcgacaagctggccgaggcgttgaaagtggactacaacgccctgtttgcccaggattaacggcacggtacggagagatctccgcgccgtgccgttttgcttccggtcatccgttgtccagggccacggtgtaggtgaaggagaggcggttgccctcctccaccggctgccagcccatgccttggaagtaacaaaagcctgtctgctccacctctgccgtgatgattacccccggctgatgaagggtgaagccccgctcccagtccgcctcctcctgctcccgcagctgggcctgccgggagagagaccagaaaggcgcctccctgcgcccccagaccagggccgtcacgatttggggcacatagctgtcaggtgtttccacccacatagctgtggtattttggaaggttccggacatggtgaccgctgtgacatggccgtcctccaccgtgtagtggaacgccttggcatcgtcccaggggttcacatccatcaggtcttccagggagatgatctggctgccatcctccggcttttcctgccactggccgtcttcatccagataggccctgccgccaaagtccagatattccgcctggcggttgtagttctccgcgaactccgccacagtcagatcccctctgttgggcggcagctgggaccagctgttgacagcctctcccactatcagcaccaggagtaccgtcaggatcagcgatgcggcgtatcggagccggaagggctttgcggtgtaggccaccccgtcgtcccagggctggggctcctctttccagcaccgccaagcagatcggaggatcatcacaagagacagtatggggatataaaagcccaatcccatccatagcatcatgagatagcgggtcacgccctcgctgtatgggaggttttttccatccattccagccagccgcatccccaacagggcctgcccggcgtggtgccccagagatgcagggacagaggttccaaaacacccagcaggaccacccccgcgaaactgatagccagtgcggcccgagtcgggttataccccagcaggcatagtcccgccaccagcagcatccgcaccagcatctcatcgaacattcgggcgaacagccgccgggaggcgctgcacaccgtaggcagccggtccgtctccggcagggccgaagcagatgccttctcccaccaggggccgccctcccccggcagggccggggcgtccaggtccgccaggtacctccccgggtccaggccggtgaatgtggcgccggtccgccgcaggtcgccgcagacccgctccacccggcccagggcggcctgttcgccgcccacctccgccagccgccggtccagcacggcagaaagttccgccctgccgtcccgcaaggcccgaagcgcctcgatggttactcccagccgccgcagcagcttgatcttctccagggtccgcaggtcctcctcgctgtaatcccggtagccgttaccggaccgggcgggggccagcagcccctccgcctcgtagtagcggatattggcccggggcacgccggaccgggcctccatctccttgctggtcaatgataccgcctcctttggcctcaggataaagtatcaagggacttgacagtcaagcctttttcgcaaaaaagccgcccgccgccggagatttcccggctggacattcccctttgcctctgctatgatggtatcatcttcgccggggctctgcaagaccaccggcagatcaataaaaaggagagactgccatgttcaccccatccgacaagtgcccccgtcgggatgcctgcgtccagaacggcaagggcctcatccacatgaaggacctgacggacaaggagggcctctataaccacggccgcctgttcgcccacgtcaccgtggacccaggctgctccatcggcgaccacccccacgaccatgagaccgagttttactacatcatcaagggcgagggcgtgttcaacgacaatggcaaggagatcgtggtccgccccggcgacatctgcgccaccggctacggcgaggtccacggcctggagaaccggggcacggaacccgtggagctgattgctttaatcgtgggagaataaaaccggatccaagcggccccaggggccgctttttcctgccctgaaaaaaactttcccctccctgaaagttttttccccgccggatcgtatcctgggtgagagcgctccaaaggagttgagatacatggacgatatggaacaggcggagcggctggccaacacatacgccgacgcgatcctccgcctcagttacacctatctgaaaaacacccacgatgcccaggatatctgccagacggtcttcgtgaagctgctgatggagccccgggagtttaagagcccggagcacgagcgggcctacatcctgcggatggcggccaacgcctgcaaggacctgctgaaaagcccctggcggcagcggtcgcaatccctggatgtcggactggaggtccccgccccccaggcgggcgacgggtctgtgctggaggcggtaaatcagctgccgccccactaccgggccgtcatttacctgttctattacgagggttaccaggctgccgagatcggtcaaatcctgggcatccccaccgcaaccgtccacacccggctggcccggggacggacgaagctgaaagaacttttgggaggatatggctatgaacagctcgtttgaatatcaggagtccctgaacagcctgcactttacagaggaggaaaaggccgccatcgcccgccgggccgctgaggcggcgcggaagcagacccggcccgctcgccgccccgtccgccggatagccctgatcgccgctgcggcggtgctggtgctggcagtgggcaccgccggcgccaccggcatcctgcggtccgctgcggaggtcttctctcccctctttggcggggcacccgctcagacggagatcatcgacaagatcggctatcccgtgggcgccagcgacacggacaacggcgtcaccgtcaccgccgacgccgtcatgggcgatgcgtataatgccgttatcgtctacaccatcagtcgggacgacggtacccgcctgctgccggaggacatcacaggcgaaatgctgctggtccacggcaacggcacggacctgagcattctgggcggaagccacggcagcagctattttgtggtggaggatcccgcagccagctccatccagatggtggagacggtcagcgccgacaagcccatcaacgactgcaccgccaccggtgtgttcgagaacctctacaagtgggacgaggaggccggcgaggccgtacccatcatcgagggtaagtggaggctcaagtttgagatgacctacgaggacagctccgtcaccctgagcggcggcgagaccttcacccaggacggcatgaccttcaccatcgactccatcaccctctctcccgtggcctacaaggtggactacaccgtggacagcgaggtggtgtggagcaactccggcagcggccggcaaagcgaagaggaccgcctcaccacacagcggtacttcgaaaacgtggaaatcctgctgaccctcaccgacggcacggtgatcgacctgtctaacgccggcggcagcatcggcccggaggatggcgtcactgtctgctccaagggcgaggtgttctctgaggtcctccccatggaggacatggcctccatctctgtgggcggcgtggtgtacgatctgacagcggagtgagctgaggcattcccaggcaggccgaaccgttccggaagcagcgcagagaactgtgcggccgcctctatcggatggctctcagacgaaggggcccgcactgctctaaattaaaactttgcctgtcctgtcaaaacgttttttgcagaagaaggacccgccggggcacacgccccagcgggtccttatcttttgcagttccggttactggggcgccacgtgctccggctttaccagatccgccagcagctccttcgcccgctccacgtcctccggcttcacggagatgtagtaggtcagccggtcgatcttcccgttggggccgaagtcccggtggtccagcttggcgccgcagccgcacgccggcgcctccgtctcatagaaaccggtctccatgaccttgatgccagcatccttcagccgctgccgggcttccttccaccggggtttgtcgccccagacctcataggccttctcacgctttccgaacagcgccatacgtcagccctccagggacttccaggcagtctccagggcgatctccatcatctcgtggaaggagtcctgccgctcctgggcggagagggactccccggtgaagatgtggtcggagatggtcagcagggacagcgcccgcttccccagccgctgggccgtccagtagaggccagccgtctccatctccagcgccaggatgccgaacttccggtacatggccccggcgtcggggttgtcgttgtagaactggtccgccgtgaacacctgacctacatctgctcggacgcccatggcctccgccgtctccaccgcgtcccggaggagccggaagtcggcggtggcgcacagctggccggggaaccggtactggtcggcgaagtgggagttggtagaggcccccagggcgatgaccacatcccggaccttcacatcatccccgatgccgccggcggagccgatgcggatgatggtatccacaccgaagaattggtacagctcatagctgtaaatacccatagagggcacgcccataccgtggcccatgacggagatgcgcttgcccttgtaggtgccggtgtagcccagcatgttccggacggtgttaaagcacaccacctcctccagatagtggtccgccacgtacttggcccgcagggggtcgccgggcatcagcacagcttttgcaatctggctctcttccgccgcgatagaggcggatggggattccttgatggccatttttgattcctccttgtaatgtagatgtcagatattccatttcgttgtcacttcttgtcgtcaaacagcgccttcaggctcttggtataaggcgggcggcagatgcccttctctgtgacgatgccggcgatcagctcatggtccgtcacatcgaaggcggggttgtagcacttcacctcgggcagagccatgggcttttcgtaccacatggtcttgatctcctcgccgtcccgctcctcgatggggatgtggtccccgtcggggcaggccatatcaatcgtggaggtggggcccagcacgtagacgggaatgccgtagtgcttagccagaatcgccacgccggaggtaccgatcttgttggcggtgtcgccgttggcggccacccggtcgcagcccacgaagcaggcctggacccagccgttcttcatgacaatggaggccatgttgtcgcagatcagcgtcacgtccaccccggcccgctggagctcatagctggtgagccgggcgccctggagcagggggcgggtctcgtcggcgaatacccggatgtgcatccctcgctccgccgccagcaggaaggggccctgggccgtgccgtatcgggaggtggcaaggggcccggcattacagtgtgtcaggacgccgtcgccctccttcagcagactcagaccgtattcggagatggccctgcatttggcgatgtcgtcctcatggatgactactgcccgctcgtacaaagcgtccagcatttggccccgggtatcgtggacatgctccaaggcggtgcgcatcatctcccggatggcccagcccagattcaccgccgtgggacgggccgcgtccagctgctggccatagtcgctgaggcgcttcaaaaacgtgggacggtcctcggtccggatggacttggccagcacatacatgcagtaggcggcgcagatgccgatggccggggccccccgcacccgcagggcccggatggcctccaccatctcgtcaatggtctggaggcggatctccttctcctcccccggcagcagggtctggtcgatgatgtaaagggcctccgccttccggtcgtagcggatgttctgggcatgggttaccgcggtgatatctggcatggtggttcttcctttccaaacggcggccgcccctccggtctcccggggcagcgccttcgtgttctcccgtccagtgtatcgcaatttccccgccgacgcaagggggggaggtcagcagttcccttttcaagctccgttgtgatggcctgaactccgtctttcaccaaccgaccttgtgaaaaatgggtttgtatgataaaataggggtgtttccagtgagcctgtgtatcaggagggattgtatgcgccagccccaaacgatctggtccttatgcgcttttatatttgggttgatgggaatcatttttgttttcctcgggatgctcttttatatcacagacatccctgtgaatggcggctgcaattggtcttttatcccaattggggcgatccttttattgggcagtattgtttgtttggcgaggtgcggtctgcaggagcagcgcagaaagcacctaaaaacaaacggcatttcagtggtcggaaaaattcaatccgttcgacatctagtttggatcaactggaacacaaagacatttgtaaactggcccgggcaatgctctccgtgggtcgttcaatgctcctactgttatggcggacggacttatacagtcaaaagcctcttgtcatggataaagccggctactgattttcagcagcccgttatttatcttgatccacgcaatccagtacatgcctatgtggatatggatacaatcaagtgggaactttcatctttttgagcgcaatcacaagccgatcatatctacaggcctctctgttgatttcaccaaatgaagcgattgcatacgattcgccaagggctaccgcagcaaaacagcagggcggcgggaatgctcccgccgccctgtgtatctgtcacacgcggaggatccagccgtccttccggggcttgggggcgggcaggtccccctccacataccccaggatgcagttgcccacaccacggtaggtctccggcagcccccacttcttcagcagttccttgccctccggccggtcaaaaagctccatggcccggttgatccagcaggagcccagtcccaaagccgcggcagcggtcatcaggtttcccatcaccagggagccgtcctgcagccagttcagcttctctccgtcccccagaaccaccaccacggtgggggcaccgtagaagggatccgtgccgggattgccctggatctccgcgttcagcttggacatccaggcaatggtctccgggtcctggaccaccaccatgacagaggtctggagtcccttggcggaaggcgcccaggtgcccgcctccagaatggcgttcagctcctcgtccctgatctgctccgccttgtacttgcggacgctccggcgctccttcaaaaccttcaatgtctcgttcatgttcgcagcttcctttctatcgttatgttgctttgaaaatcaaatggctccgggttccagcacctgccccataatctcccggcacttttggtacatcaggatggtgtcgcgcaggccaggacgcacaggtccgccgcttccccggcccggaccatctccacagttttctccgggccgtaataggtgtgctccagatccacggtcaagaaccggaacccggcgtagcccgcggcctccacaaactccggtgcagcggactggatgaaggtccccagaaaaggccgcccctccgccagcagagcggaaaatgcaacgtgcatggccgtgcccctttctcatctattatagcacatccccccggaattcccaacgttttttcacatcaggtatcgcccctttgcggattccggaggtgacagctgtcccgtgacgtgctatactgataaaaatattgcgctttggcaggactttttcccaactgttccaaattaaggagtgattttgaccatgccccagcctctttctgaacgcaccgccagtttcaccgattccgtgatccggcggatgacccgcgtctccctgaagtacggcgcggtgaacctgtcccagggcttccccgacttcgagccgccccaggcgatcctggaacggctggcccaggtggcccgggagggcccccatcagtactccgtcacctggggggcccagaacttccgagaggccctggcccgcaagcagtcccgctatatgggccgcaccatcgacccggacaaggaaatcgtggccacctgcggctccaccgaggctatgatgtgcgccatgatgaccgcggccaaccccggggacaaggtcatcgtcttctcccccttctatgagaactatggggcagacaccatcctctccggggcggagcccatctatgtgccactgcacccgcccgccttcaccttcgacgtggacgagctggaggctgccttccgccaacgtcccaaggccctggtgctgtgcaacccctccaacccctgcggccgggtcttcacccgggaggagctgctgaccattgcggagatggccaccagatacgacacctacgtcatcaccgatgaggtgtatgagcacatcgtctacgccccccaccggcacacctacttcgccaccctgccggggatgtggaaccggacgctgtcctgctcctccctgtccaagacctactccatcaccggctggcggctgggatacatcatcgcgccggaggagatcatcgaccgggccaagaaggtccacgactttctgacggtgggctgcgccgcgccgctgcaggaggcggtaatccccggcctggagttcggccaggactactatgacgacctgctggccaagtacacccacaagaaggacctgtttctcaaggggctggatgacctgcacatctcccacaatgacccggagggcgcctactacgtgctgctggacatcagagagtacggctatgagagcgatctgcagttctgcaagaacctggcccgggaggtgggcgtgggggccgtgcccggctccagcttcttccgggagccggtgaaccacctgatccgcctccacttcgccaagaatgacgacaccctcaacgaggccctgaaccggctggagaagatccagaagctgaaaaaataatccccctcgggcccgtccggaaaacccggacgggccctttttcgtctaaagacagaagaggttctcttccctccgccccagtccgcgcatatccctttttctccccgcataggatggagcaacaagaggcggggagtgttgtgttttgaagggtaacatggaggagcgggccgaacggctggctcagtacatcatcgaaaaccggaccacggtccgcgccgccgcacagaaattcggcatcagcaaatccacagtgcacaaggacatctccgaacggctgccccagttcaatcgggtgctgtaccagcaggtgaaggaagtcctggaggtgaacaaggcccagcgacacatccgcggcggcatcgccacccggaaaaagtaccgcggggaataaaatgcgcatagactagtcttagaaagctcgcaacggaggaatcgatatggcaaagcaatcccgctgccgccgcgtggcccggtccacaccggagcccccggtcgccgcagtgccggccaccccggagcctcccgtccgccgctggcctcacccggtggagggcgtggagcccatccaggacctggatccggcactccattacatacgatgcgccctctcctatcagaaccaattgctggctgacatcaagactctcttgcagcagctggttccggaggagacccgggaagatgcggagaattcctgaaaaatggcgtgccgcgctccggcacgccattttcctcttgtgtttttccgcttcccgttttataatgttgcaacgagtattatgtaaatcttctcacccagtttttccaaagaaacccccgcggcaccgccgcggctgtaaggagcgttttgaatatggcaaagagaacccgccggagacggcgcagctggagcagactgctgcttctcgtggtctttgtggccgccgcactgtatgccggctacttctgtctcttccgtcccctgaggtccccgccgaaaccacccggcccgacgaagcggaggaggtctccgccgaagacaccgcccaggacgcagaagtcctggcccaggcggcccatctggagcgcaagccctatttctacaccattctggtgtccggcgtggatgaccacaatggcggcagcgacaccaatatcctggtggccgtggatgcagagaacgactacatctatggtgtcagcatcccccgggacaccaaggccgtcatcaatggaaagaaccacaagatcaacttcgcctataactccggcgggaccgctctgctggccgagaccatctcccagcagctgggcatcccagtggattttacggtaaccgtagatctggacggcttcgccgcgctggtgaatgccatcggcggcgtggactttgaagtccccatcagcatgaattacgacgatccttaccaggacctgcacatccacttctccgccgggatgcagcatctctccggtgcggaggcgctgaaggtggtccgcttccgccacaacaacgacggctccggctacggcagcgaggacatcggccggatgcagacccagcagaacttcctaaaagccgtggctcaacagacgctgacgctctccaacgtggacaaggtgggggagttcgccaagatcttccagcagtatgtggacacggacctgtcccttgggaacctggcctggctggggaaggaggccatcagcatgggcgtggataagatctccttctccactctgcccaacgagtggcgctccccctacatctatctggacccggacgccactctggagctggtcaaccagtacctgaatccctatgtggaggaccggaccatggaggatttggacatcccctcctgaaaaggcccctgtccgcgttttgttccatcaggcagaaatcctgaattcgatcttccattttgtataaggaggtgccgtcatgaagaaacgggtccccgcgctggtgctggcactggcgcttgctcttactgtccccgcctgggccgcccaggacaccccggacaattttgtccgcagcaaaacctacgccggccagttctccgacctgacgccggagtccacgttctacgacaatgtggcggcgctgtatgcgtatggtctctccgtaggcaaggccgacggcactttcggcctgcgagaccagctgaccgttgggcaggtggtgattttcgccggccgcatccgcagtctgtaccgcaccggagacgcggaggcaggtccaggcgcctatgccgccgagaatgaggcagcggccctccggtacctgcgctatctccagtcggagggtgtcatcggcacggagctggacgagtccctctccacccccgccacccgggcccaggtggcccatgtgctggcgaacacgcttccggaggaggccctgccgcccgttcacgcggacctggtaactcaggcttacgccagccggcagttcatcaccgacgtgaccgagtacaccccctattaccaggacatcctgaccctctaccgcaccggcgtgtccgtaggcagcgacgccgctggctccttcctgccggaccagcccatcacccggggcgcggccgccgccatgctgacccgcatggtggatccaagcctgcgggcaacgccggactgggacctgggaaaggagtcctggagcgccctgggcgctgccatgggagatctggtgcccttggggacgtatatcgccgctcccgccactgcggcggagatagatgaaagcgtccgctacatgctggcatccaaccagaacacgctggtcctgcagtaccccagtctctccgtaacctccgcccgacgggtgatggaggcggccctggcagctgtgaaaacctattgtgagcaatgctacaacacggtcaactgcacctattctgcggacgggtccatcaccctcaccttctccgccgccagcgcgggagatcagatcctgacttaccgcgacgcggccatggaggcggccattgccgtccatgatgccctgtgggagagcggagagatcaccacctccatgtccgactatgagaaggcccgggtctacttcacctggatctgcgataactgcgtctatgattacaccgccggggacagctccctgagccatattgcatacagcctgtttgaaaacggcaccgccgtgtgcgacgggtacaccggcgcctacaacctgctgctgaagctggagggcatcgactgcacagccctctccaacaactcccacatctggaccgtggccaccttggacggcacagactaccacatcgacaccacctggggcgacagcggccccgcccccaattacgactacttcgccatgactgccgaagagtcctggcagcaccacagctggtaagctgttgaaaagcgcccccggcttttgccgggggcgcttttttctcttcaggggctgccgactttcaaagatgatggtcccgcagcagccgcttggcctgctcccacagctcgtcgctgacagtctggaccaccacgaccttctgcaccagctccggcagggcagccgtcagctcatgctcgatcagcgtctcgttggtcaggtccgcggaggggcacccggcacactggcccagcagcttgatatacagcacgccgtcctccaggtggtcgatctccagctcacccccgtgggcccggagagacgggcgcaccttctcgtccagcacggcttcgatctgcttccactcttccctcatgtgttttcctcctgttctgccgccttggcggcggcaatctcctcccggatgcggtggcgggtgctgtcaaacagcagctcccggttgtggcggaaataggcgtcacagccaaactgctccacgaaccaggaggtgttgtacccgacggtgatctccgtgacgaagatcaccagctcctggctgttgccgaaggtggtctctaggaaacggaaggcgttgtcgaacatgtccttcgtctccatggccacggccttccgccgctccacctcttcaccgaaccagccccggacggcgtccatagccccttccggggccacggcctcccggtccagccgctggcggtagtcctccagggcgttgatctcccgctgcttgaggtcccgggactccttgtccaactggccggcctctttggcctgcttcatggcagtacgccgcttccacagcagctggtccagcaccgtcagcggcggcgcgtccgcgatcttctcccgaaactctgtcagggaggtgtggagggcgtcggtcagggcgtcctggcagcgggtgttccgggcttcctcgctgagccgggacagcaccagccccatgacggagagcttctcatcaaagggcgcctcccgcagctccagcacggtgatgttctcccaggtgccgctgaggatcccctccacgtggtaggtcttttgatacttgtagaacatctccaggtaattggcgaagtccttggcaatgcggggcatctggatgtactgccccaccacctcccggtccgcccggatgcccagggtctcataagcgtacagcagttcgctgagatcctcccagccccgggcggtggcaaactggaggccgtctgccgtgttctcgatgcggtagaagttgtccttcttgatgtccaggtaggagaggatggccccgtggaggttcttccggcgggcgtactccttccacacgccgtagtcctcctccacgtcgatgcgcttcacccggtccagggtcaccacgtcgaagtcccggacggacttgttgtactccggcgggttgcccgccgccacgatcagccacccctcgggaagggcctggttgccgaaagtcttgcactggaggaactggagcatcatgggggccagggtctcgctgacgcagttgatctcgtccaggaagaggatgccctcctgcagtccggtccgctccatcagccggtaaacggaggagaggatctcgctcatggtgtactcggtgacggagacctcctccccgccataagtccgcttttcgatgaagggcaggccgatggcgctctgtcgggtgtggtgggtgatggtgtaggccaccaggcccacgccggtctcggcggcgatctgctccatgatctgggtcttgcccacgcccggcgggcccatcagcagcaccggccgctggcgcactgtggggatcaggtagttccccagctggtccttggccagatacgccttcaaggtattggtgatctcctgctttgcctgtttgatgttcatatcgttagctccttacagttggggaagttcgtccaaatcgatcaggtccagcccggcggctttggcctcctccgctgcctcccgggcggcctgttccagggccggggtgggcaccaccagccggatggcccaggggggcatctttacggacaggggcggctcctccaacagcacgaaggccgtgtcatagggcggccgcttccggggatagacgcccatgccgtcggtgaagtataccagcccccgaaggaaggtgaaggccccctctacctggagctccgccacgtgttcaaacaccggccggaagtccgtggcgctgccgcccatcagagagaagttctccatataggctttcaattcctccaggtcgcggatgggggtgtcggaccggacctggtcgtcgcactggagaatgcgaatgttcaccttccgagtgaaggtctccgtgctgcggaggatggcgtaagtgcaggccagaaactgccgcaccagctcaccggaggtagacatggaggtgtccacggcgatgacgaagtcctcgatccgcttctcctccttcgtctccggcggctccaccaggggcatgttgccgtagagctggaggccgtaggtgtagaagatatagtcaaaggcgtcgccgtccaccgccatcacctcccggggcacggcgaaccgccggaggaaggtccggtagtccacgtcgtcccggttggccacctggatctgctccagcaccgcctcgccgccggtggccttgccggccagcacggtctccagtcccgtctgggtcttttcggagacgccctgccacttctgctcccgctgcttctgctgctcctggtcctgctggtccgggtcccacaggccatggtcgtccaccagaaaggtccgctggagccgggccacctcgtactccggcaggtccagccgcaggagatggcggtagatgccctccgccgtcagcaccggcatctctgcccggcactcgccgtagaacttctgcttggcggggacgaagcccccggccaggcaggggtagtccagctcgtccaggatgctctccaccgcgacatcgcaggccagatcccacagctccgccaccctgccccgcttcttccacaggtgccgcagcatacagtggagcagcacgtggagataggcccggtccaccgccgtccgggaccggagataccgctccgagaggaagctgccgtcgtagtacagcgtctccccgtcggtggccagggacagcgtcaccccgccgccgggctggaagtccaggctgcacagcgccacatccagatagggcagattcagatacagttcattccgggccgtctgcaaaatctccagtccgatggccgtcaggtccttggccgccatggtgcgcctccttccctgctataagtcaaaagtcttgtccagcccccggggggccacatcccgctgctgttccagcagcagggccagggcctcggagaccccgctctccctcgccagggcgcaggcggcggacagggcctcccggtccggctccgccgtcctcagcagaaacgccagccccggcatgtcccgctctcccaccagccagactgccgcctctccggcgtgggcccggaggtaggacaggtactgcccctccgcccggggcgtcagctccaccgggtagcgcagccgccagaaggccagccgcaccgcgcagtcctcatcgtgctccatgcccagaaaaccgctccacagctcgtcatacgtccgcaggtccagccgcttccggcggaaggagtggtgatagggatatccggcgccgaagatgttgtaatcaaagtgatgggccgggcagttctcctcataaacctcccggtactccggaaagagcaaacggaacacggtgccgtccgtctcctccacggtgacgtccagctcccagggcagttcgtcggcaaaccaggccagggtgtccccctgctcccccacccgggtcagatggaaggctgccagccgtcggcagttcatcagcaccccgccgccccactgaccgatgccgtcgtgaagccgcagggtccgcaggccgccgcagttcatcagggcgtaatcccccacccgctccagggaccggggcagggtcaggtcctccaggtcccggttgctccaggtccccgggtccgtcccggtgccgcaggtcaccagcaggtcctccccctccgcggaagcggcggtgggcgagagggcgtggtcccccagggccgtcaccggcaggccgtataacgtctccggcaggcgggcccgggcgtcgcaggtggccgcccgcaggatggtaatccccgccgcctcccggcgaatggttagcttccagtttccgctgccggggatggtctccacggcgctcacctccttttctccggacaagccgtcagtctcagctttagtagtgtatcacattttctgttgagagcctagccccaaggaccacaaaaatttttgcgggatccagcatttccctcttgacaatccgtgcatactgtatatactgtaaatgtacagtacgaacaggagtgacttccatggaactcatcatccgcaataccaccaaccaacccatctacgatcagatctactcccagatcaaagcccagatcattgccgggaagctctcccccggagaggcgctgccctccatccgggccctggccaaggacctgcggatctccgtcatcaccaccaagcgggcctacgacgagctggaggccgacggcttcctctacaccgtggccggcaagggctgctttgtggcggaaaagaatctggacctgatccgggagcagaagctgaaggagctggaggaccacctggacgccgccgtggagctggccgcccagtgcggcgtctcggcactggagctgatggaaatgctccgcatcctgctgaaagaggaggaacctcacgtatgaacgccattgaattgagccatgtgacgaaacactttcccggctttaccttacaggacctgtccctcaccgtgcccagcggcaccatctgcggtctggtgggagagaatggcgccggcaagtccaccaccatccgcctgctgatgggggccctgcggccggacagcggcacctgcaccgtcctgggggcggattccgccgcgccggagtttctctccctgaaagaggacatcggcgtggtgctggacgaggcctatttcccagagagcctgaacgcccttcaggtgggaggcgtcatggccaagacctaccgccgttgggacggaaaacagtaccagaattacctcacccgcttcggcctgccggagaaaaagcccttcaaggacttctcccgtggcatgaagatgaagctggccatcgccgtggccctgagccacagccccaggctgctggtgctggacgaggccactgccggcctggaccccatcgtccgggacgaggtgctggagatcttcaacgagttcacccgggaggaggaccactccatcctgatctcctcccacattttgagcgacctggagaagctgtgcgactatatcgccttcctccaccaggggcggctgctgttctgcgacgagaaggatcggctgctggaggagtatggcatcttcgtgggcacggcagatcaagtgaacagccttcaggacggggccgtggtagcccgggagaacagcagcttcggcggcgtccggtgcctggtgaagcgggcgctggtgcctgcgggctgggcgctggagcggcccacagtggaggatatcgtcctgtttttggtgaaaggagcgaaggagcaatgagtgccctgcttttgaaagactactacgtgatcttccggcagatgaagatcttcctgctgttaattctggtgttctcctgcatccccggcacgttttacagcacctttgccgtggtgtatgcctctatgctgccctacaccgccctggcctatgacgagcggagccgctgggaccagatggctgccatgatgccgtattccgcccgggacgtggtgctgagcaagtatctcttcggctggatcgccgtggccgtctcggcggcggccacctttgtccttcagaccatcctgtcggtcatctggctcagcgatgtggagggtccctccatccccgtcatcctgctgtccgtgtgcgtggccgtgtgcatcctggacatcaccctgcccatgatgttccggttcggcgtagaaaaggggcggctggcgatgttcctcatcatctttctggtgtgtgccagcgccggaggcatcgccaccattgagcagtcctccctggacggcggcttctatctgtccctctccctggttcccgccgccatcgccgccgtggtgctgaccgtggtgtccatccctctcgccatccggttttacggccgccggagccggtgagcggtatggaggatacaccgaaaacgctctgcccggcgccggccccggcggacctggccgcgttgctggccctgtgcggggcggccctcctgaatcgaaaggagccgaaatgaagaattcgcacacctgtcccaagtgcggcagcagagacatcgtccgaatccccgaccaccccagccgctacgctagcggcagcaacatttacaccacccggtacaccctgctgggcaaggtcccggtgatccgctacgtcagctgcggctgcgggtatgtggagaattgggtggagtcccccatggagctggtccagatccaccagacctacggggctccatgactcttccaaaggccgggcgcggagtttccgcgcccggcctttgccgaaatccacagaaaaccagttggaatcgccctgcggattctgccggttttgccatctgacggccgttgacattttcccaagccggtgctacactgaaacagtattttttggaaacgctttgggcagcggtttgcggcggatgccgcaacgcgacaaccgaacagacacaccgcggaccgcggccgaacgtcccgaaagagactgggactttcagccgcaaaatcggtccggcggtgttttttgttatgcttttgcataacaaaaaacgaaaatgcgccatttccccgcccctttggggcaaccggaaatgatgcgcaaaacttcatgcgcagcggcatttgcctgtattcgtggtgcactgtaccgcgcatgaagtttgttttttgtttgtcggcccggggcgtacaattcggtttcctgctaaaactgtttgcgtggaaaggcaaggtgagcggcatgtcaacgaaattcgtattcgttaccggcggcgtggtctccggcttgggcaaggggatctgcgcggcctccctggggcggcttctgaagcagcggggcgtccgggtgcggaaccagaagttcgacccctatatcaatgtggacccggggactatgagtccctatcagcacggcgaggtgttcgtcaccgaggacggagccgagacggacctggacctgggccactacgagcggttcgtggacgaggacctcaccggcaacagctccgtgtcctccggcaagatctactggtccgtgctgaaccgggagcgccggggcgactacctgggcgccacggtgcagatcatcccccacatcaccgacgagatcaagcgccgcatctacgccatggcggaagaggacgtggacgtggtcatcacggagatcggcggcaccgtgggcgacattgagtcccagcccttcctggaggctatccggcaggtggcggcggagcggccccagggggatgtggtgttcatccacgtgcccctcatcgtccagatccccggcagcggcgagctgaagagcaagcccacccagcactccgtgaaggagcttttgtccctgggcatccagccggatattctggtatgccggtgcgacgtgcccatcacagaggacatccgccggaagattgccctgttctgcaatgtccagccggactgcgtcatccagaacgccacggcggagacgctgtatgaggtgcccctgctgatggccaaggagggtctggacgaggtggtgtgccggaagctgggcctcatcactcaccagccggatctgcgggagtggagcgccatggtgaagcgggagaagaacgcccgcaagcgggtgtccatcgccctggtgggcaagtacacccagctccacgacgcctacctctccgtggtggagtccctgaaccatgcgggcaccgccaacgacgcggtagtagacatccggtgggtggactctgagaccctgacggaggccagtgcggcggagcggctggcgggctgcagcggcatcctggtgcccggcggcttcggcgaccggggcatcgagggcatgatcgcggccgtgcggtacgcccgggaacactgcattccctacttcggcatctgcctggggatgcagatggcggtgatcgagttcgcccgccacgtgctgggctgggcagacgccagctcctccgaattttcctccaccgcccacccggtcatcgacctgatgccggaccaggtgaatgtcaccgccaagggcggcaccatgcggctgggccgctacccctgcgtgctggcagagggctcccgcagccgggagctgtatggcgcggcagagatctccgagcgccaccgccaccgctacgagttcaacaacgatttccgggcggagatgcaggtgggcggtatgcggctggcgggcctgtccccggacggccgcctggtagaaatcatcgagctgccggaccacccctggttcgtgggtgcccagtttcacccggagttcaagagccgtcccgaccggccgcatccgctgttctatgggtttatcaaagcctctgtggagaaaatggaagctgacactcaataagtcccgggcgggacggctatctgccatgtgggcggttgccccgcaaggggcgagcccgccagcatctctcgcggactgccgctgcggccgtccgtcccgaccggccgcatccgctgttctacggatttgtaaaggcctctgtgaagaaaatagaggctcaggaggtaacacgatgaatcattttgctaaaatcgccgcccagctggaatcccgtgacctggacggtatgctgctgacccatgaggccaaccgtttttacgcctccggcttccactccgccggaaccgacggcatggccctggtcacccgagagaagttctattacttcaccgactcccggtacacagaggccgcccggcggcatgtgcaggatgcggaggtccaggaggcaggccacggccggggctattccgccctgctgatggaggccgtccagcgccacagcatccagcgcctggggtttgaggacgcctatatgaccgtccgggagcacgacgcctatgcccgggctctgccctgtgagctggtgcccgcggcggacctgctggcagaactgcgggcggtaaaggacccggaggagctggagatcatgattgccgcccagcggattgcggagaaggccctgacggatatcctgaacgagatccggcccggcgtcacggagaaggagatcgccgcccggctccagtatctcatgctccactacggggcggaggacaagtccttcgatcccatcgtggtgtccggccccaacggaagcctgccccacggggtaccctcggaaaaggtcatccaggccggggagttcgtcaccatggacttcggctgcatctatcacggctactgctccgacatgacccgtaccgtggcggtgggatccgtgacggatgagatgcgccaggtctacgacacggtgctgcaggcccaactggcgggtatcgcagccgcccgggccggggccactggaaaggccgtggacggcgccgcccgggacatcatccggcaggcgggctacggtccctgtttcggccacagcttcggccacagcgtgggagtggagatccacgaggggcccaacgccactccctccaacgacaagcccctgcccgccggggcggtgatctctgccgagccgggcatctacctgcccgggaagctgggtgtgcggattgaggacgtgctgtacctcacaccggagggctgtcaaaacctcactctggcccccaaggagctggtcattctctgaccccgattcaatcccacgcaaggaggaaaaatcccatggcaagctatatcggcgcgtccgccgagcaggaggacgccgaccccattctcatggcctttgccgctgaggcgaccaagggcgaccccgccagtccggaggcccgggagctggtgctccgctggcaggcccatctggtgaagttcagccgcagctgcgacgaggagaagctccgccgcctggcggacctgtacagctgggacaaccgctttgcagaggttctggacagctacggccccggcacagcccacttcatgggcgaggccatcgaggcctatttggaaaccctgtgaacgccgtcgcgcaccggcgcaaaaccgcctccgcccccgctggcggaggcagtttttgcccttccggcccccggttttccggcctgcgggctgttgacaaacctgcgccggagacgcataataaagctatcaacacgccaaaaattggatgccccgcatccacttgagagggagtattcatggacaccatctatatcaccggacaccggaacccggacacggactccatcgtctccgccatggcctacgcggcgctgaagaacgcccttggccagcggcagtacgaggccgcccgcctgggccagatcagtgacgagacccagaccgtgctggatcgcttcggcttccagccccccaagctgctgaacaacgtgcgtacccaggtccgggacctggattacgacacgcccgccaccctgtccgccgctgccaccatcagccgggcctggcggaccatgcagaaggacaagatctccgccatccccgtggccaatgaggacgggaccctgttcggaatgctctccgccggggatgtggccaactatgacatgtcctccgtccgcaaccctaaggtgggcgagatcccggtgtacaacctgctgtccgtgctggagggcaaaattctcaaccagggcggcgagatgcgggacgtgatctccggtgaggtcaccatcgccctgcccgccagccgggagaacctggtgttctccgacccgggcagcatcgtggtctgcggcgaccagccagacatgatccgccgtgcgctggagatcggcgtcagctgcatcatcgtctgtcaggcggaggtggacccggagctgctggccatgcagacggacacctgcatcatctccaccgcctatgacgcctaccgggcagtgcggctcatctaccatgccatgcccatcagcagcatctgcaagaacaaggatctggtgtgcttccacctggacgactatatcgacgacgtgcagaacaccgtgctggaaagccgcttccgggcctatcccattctggatgaggaggagcgggtggtgggcaccctgtcccgctaccatctgctgcggccccgccgcaagcaggtgatcctgatggaccacaacgagaaggcccagtccgtaccgggcctggaccaggcggagattctggagatcatcgaccaccaccggctggcggacatccagaccaagaatcccatcactgtccggaacgagcccgtgggcagcaccaccaccatcgtggcggggatgtatcaggacaagggcctgatgcccaccgccaagatggcgggattgatggccgcggccatcgtctctgatacggtcatgttcaagtctcccacctgcacccagcgggacatcgacgtggccaaccgcatggcccggatcgccaacatctccctccaggcgctgggacaggtgatcttctccgcctccggcggcggtgcgaagtctgcagaggagatcttccgcacagactacaaggagttccacatcgcaggccacaacctggcggtgagccaggtcacctgcatggactccgaccagctgctccagcgcaagggagagtttttgcagctcatgagctccctgcagaagaagcagggcttcgacatggtaatcctgatgattaccgatgtactgctggagggcacccagctgctgttcgtgggcgacagggacagcatccgccaggccttcaatgtggaggatgcggaggacgtggtgttcctgcccaaggtcatgtcccggaaaaagcaggtcattcccatgctctccgccctgtggggctgaggagcgcgtggccccgccgcccggcgctttctgctgaggaagctgccgggcggctctgttttttgggaaatctcctgcctctgaaacattttccagagattttgtataaattcaccattgactttgcctgtttaaagcagtatggtgtaaaagtacaaaggccggtcggcagaagggagctcttccatggttttgtttgcagcagcgttccgcactgtggcggggttctctcgattttatggctgccaggtccgctatgcgggccgatattgtcataggcagagcagccagtgaaggtccggcggccggtggatctcaccccgtatggaaggcggctctgctcttcggacagagccgctttttgtaatttccccgcgatcaatcttgaaaaggagatctctgcgatgaaaaagaagtttcttgcccttgcgctgaccgccgtcatggctctgagcctggctgcctgcggcggcgacacccagtccacagataccgatgccgataccagcggcgacgagtccgcctccggcagccagacctacaccgtgggtattatccagcaggtccagcacgaggccctggacgccgccacccagggctttcaggacgccctgacggaactgctgggcgacagtgtcaccatcgacccccagaacgcctccggcgataccgccaactgcaccaccattgccaacaactttgtctcccagggcgtggacctgatcatggccaacggcaccaccgctctccaggccgctgccaccggcaccagcaccattcccattctgggcacctccatcaccgagtacggcgtggctctgggcattgacggctttaccggcaccactggctacaacgtctccggcacctccgatctggcgcccctggaccagcaggctgagatgctgcacacctggttccccgacgcccagactgtgggcctgctgtactgctccgccgagcccaacagccagtatcaggtggacaccgtccaaggctacctggaggatctgggctatacctgcacccaatactccttctccgactccaacgacctgtccgctgtggcctcctcagcctgcacggccagcgatgtcctgtacgttcccaccgacaacaccgctgccaacaacgccgaactgatcggcaacatctccctggacaccggcactcccatcatcgccggtgaggagggcatctgcaagggctgcggcgtggccacgctgaccatcagctactatgacatcggctacaaaaccggtgagatggcctatgatatcctggtgaacggcgccgatcccgccaccatgcccatcgagtacgccccccagttcacccccaagtacaaccccaccatgtgcgaggctctgggcctgaccccgcccgacggctatgaggccatcgccgaataaggacgaatggacggagaaccgataaagagccggcggatgttttcaaattcttgtctgcaaaacttccgccttcaccggcggggagccctctccggggctctccgccgcccggtctccgtcctatgggcggcgtctgcggtatgccacccttccgccccgtcatccaaatcttatcaacacactttcagcggaaaaggggcttcccctttccgctgaactttgctagaatagagcagcaaattgcctccggaaacagccgggggattttggagggatttcacttgaacatcatgcatctggtcaacgccctgccgggtgtggccgcccagggactgatctggggcatcatggccatcggcgtctacatcacgttccggatcctggacgtggccgacctgacggtggacggcaccatggctaccggcggcgccgccttcatcatgctgaccatggcgggggcgccggtgccgctggcgatgctgggggcgtttctggcgggtgtgctggcgggactggtcaccggcctgttccacaccgcctgcggcattccggcaatcctcgccggtatcctcacccagctggccctgtactccgtcaacctgcggatcatgggacaggccaaccggcccgtcagctcccgacagtatgacctgctggtggaccagcagagcgtccgctccctgagcctggacaaccccatcctggtggtagccatttttgtggcggcggtcattgccctgctgtactggttcttcggcacggagctgggtgcctccctgcgggctactggttccaaccccaatatgtcccgggcccagggcatcaacaccaacttcaccaaggtgctgggcctgatgctgtccaacggactggtggccctgtcctccgccctgctggcccagtaccagggtttcgcggacgtgaacatgggccggggcgccatcgtcatcggccttgccgccgtcatcatcggcgaggtgatcttcggcaaagtgttccgcaactttgcgctgaagatgctggctgtggccatcggcgccattttgtactacctggtgtaccaggtggtcatctggctgggcctgaacaccgatgacatgaagctcatcaccgccctgatcgtggcggcctttctggccatcccctactggaaggggaaatacgcccacgtcaaggtgcccgccgggagcgccaatgccggagcaaaaacaggaggggatcaggatgcttgagatcaaggagatctggaagacgttcaacgccgggacggtcaatgaaaagcaggccctccggggcgtcagcctgacgctgaaggacggtgacttctgcacggtcatcggcggcaatggcgccggcaagtccaccatgctcaatgcggtggccggcaccttttctgtggacagcggcgccatcgtcatcgacggggtggacgtgacccgcctgccggagcacaagcgggccaaattcatcggtcgggtgtttcaggaccctatgatgggcaccgcccccaccatgcagatcgaggaaaatctggcgctggcggcccgccggggccagccccgcggcctgggctggggcatcaccaagacggagcgggcggactaccgggagctgctgcgggacctggggctgggtctggaggaccgtctgaccagcaaggtggggctcctctccggcggccagcgccaggcgctgacgcttctgatggcctctttgaagcggcccaagcttttgctgctggacgagcacactgccgccctggaccccaagaccgccgccaaggttctggctctctccgaccggatcgtggaggaaaacggcctcaccaccatgatggtcactcacaacatgaaggacgccatcgtccacggcaaccggctcatcatgatgtacgacggccgtattgtcatcgacgtgtccggcgaggagaagaagaagctcaccgttcccgacctgctggccctgttcagcaaagtcagcggctctgacgaagccgacgacaagctgctgctttcctgagccgcggaaaacccgattcaaactgcatgttactccccggcagggccatcctgccggggtagttcttgccccggattttatctctttaaagcagcaaaaaagatttgtgcaaaatcacggttgacatttccgccgccgcttcgtataatgcaaagcaatcaagcaaaaccgatgagcaagaggagtacctggtcaggtcacctttcagagagccgtggatggtgggatcacggcagagaactttccagcgaatggacttgcgagggcagcgcaaacggcaaaatgctcagtagcgtctgacggggcccgcacccgttatccgggcggcgcgtatgaatgtacgtggaacgagcgggcgctttgcgtcaacttgggtggtaccgcaggatggtttcaagtcttgtcccaaatatggggcagggctttttttgattcccctgatcggtccgggaaaggagtatggagatatgaaacacaataccagacgatggcgcggcctgtgctgcaatatcaattccctgaacggacccctttcaaatattctgtatcaaagattggagaatctattatgatgaatctgctgaagaagctggccgcctgcggcctgtccctgaccatgatcctgtccctggccgcctgcggcggcaccgatgacacctcctccggcgaaagcggcggtgagcccgtcaagtatctgatcggcatcagccagtacggccagcacggctccctggacaactgccgggagggtttcctccagggcctggagcaggccggtctggtggagggcacggactttgaggtggactaccagaacgccaacttcgacgacaaccaggctacccaaatcggccagatgttttccgccgaggacgcggacctgatggtgggcatcgccaccaactccgccatcgcctgcttcaatgccgcggaggacaaggacatccccgtgatcttcaccgccatcaccgacccggtgggcgcccacctggacgcgggcaacatcaccggcacttccgatgccctgccggtggagggccagctccagctgatccgggccctgcagccggatgccgacaccatcggcatcgtctacaccaccagcgaggccaactccgtctactccatcagcgtctatgaggagctggcaacggactacggcttcaccattgacgcggtgggcgtcacctcccaggcagaggtcacccaggcggtggataccttgctgtcccatggggtggactgcctgtccaacctgacggacaacaatgtggtgggcgtgctgggcgccattctggagaagacggacgaggcgggtatccctgtctacggttccgaggtggagcaggtaaagctgggctgcgtgggcggcgcgggcctggactacatccagctgggcatccagaccggcctgatggccgccaaagtcctcaccggcgaggccgcctgtgaagacctgccctacgagaccatcgaaaactatggcctgtatatcaactccgacgcggcggccgagctgggcatcaccattcccgacgacatcgcccaggaggcccaggagtgcgcggaataacatctgtaacatccattaccaaggagaactcttcatgaagcttgtcacctatcgtctcagcggcgccgagcatgtgggcgccctcaccgccgatggaaagggcgtgctgcccctccccgccgccgatatgaacaccttgatcgaaaccatgacccttgccgaccttcgctctgccgccgcggcggcagagcggggcggtgcggtcccgctgtcagatgtggagctgctggctcccatcccccgcccccggcaggatgtggtctgcctgggcatgaactaccgggaccacgcggaggaatccgcccggtacagcgccgatgccttcaccaagaacagtacagcggcggtctacttctccaagcgggtcagcgaggccgggaagcccgacggcgtcatcccccgtcacgcgggccttacggaccggctggactatgaggcggagctggcggtggtgctgggcaaagccgcccgggacgtgaaagccgtcgatgcggcagactgcatcttcggctacaccgtcctcaacgacgtatccgcccgggacctgcagacgggccataagcagtggtatttcggcaagagtctggacggcttcacgcccatgggccccgtactggtcaccgccgacgagatcgcctatcccccggcgctggagatcaccagccgggtcaacggcgagctgcggcagaagtccaataccgctctgctgattacctccatcgggcagatcctggaggagctgaccgggggaatgacgctgctgccgggcaccatcatcgccaccggcaccccggcgggagtgggcatgggcttcgatccgcccagattcctccagtccggcgacacggtggaatgcgccatcgagggcatcggcaccctctgcagcaccgtgatctgatcttttcacaaggaggcttctcatctcatggatgtgatggaactgctgaccagcactctgatccaggggctgatctacgccctgatctcctacggcgtgtatatcacctattccattctggactttccggatctgggggtggatggcacgtttcccctgggggccgctgtcacggcggtgctgatgaccaagggcgtcgatccctggctgaccctgcccgcctccctgatagtgggcggtctggcgggacttttcaccggtctggtccacgtgaagctgaaggtgcggaacctgctggcgggcatcatcaccatgaccgccctgttctctgtgaacctgcagatcgccgggtccaacctgaccatcgaccggggtacggacaccattttcacctctgccccggtgatggccctgtttggggatctctccctctccgggcggaagctgattgtgtccctggcgctggtcatcgtcatcaagctgctgctggacgcctatttccacacgaagtccggcctgctgctgcgggctgtgggcgacaacgccaccctggtgaccaccttggccaaggaccgaggcacagtaaagatcctggggctggtgatctccaacgccctggtggccttcggcggctgcatcgtctgccacgaaacccgcagcttctccgccaccatgggtaccggccagctggtgtacggcctggcggcggtgattatcggtgtgtccatcatacacttctacaccggcacccggctggcccggggactgcggaagtccgggcccctccgcttcctgggttccccccagggcaccacggcggtagtgctgggcagtgtgctctacaagctgtgcatccaggtagccatgagcctgggactgcccaccaatatgatgaagctgattacggctgcactgttcctgctggtgctggtgctgtccggccggaagggggaggcgatcatccatgcttgaagtacgggacatcacgaagatctacaaccccggcaccctgacggagcagcggctgttcgagcacttctccctgacagtggaggagggccagttcgtggccatcgtgggcagcaatggcagcggcaagacctccctgctgaacatcatctgcggctctatccccatcgagggcggtgacgtgttggtgggcagccggagcatctccaagctgaaggactaccagcggtacgccaccatgggccgggtctaccaggaccccgccgccggcacctgccccaacctcaccatgctggaaaatctgtccctggcggataacaagggcgggtcctacggcctgggccggggcgtcaataaaaagcgtatcgacttctatcgccagcagctggcctccctgggcctgggactggaggataagctggatgtgcggatgggggctctctccggcggccagcggcaggcggtggcgctgctgatggccaccatgacgcccctgaaattcctgattctggacgagcacacggcggccctggaccccaagaccgctgaggtcatcatggccctgacggacagagtcatccgtgaaaagcatttgacggccatgatggtcacccataacctccgctacgcggtggagtatggagaccggatcctgatgatgaaccggggccgggtggtgctggaccgggccggagcggaaaagcgggccacctctatggacgatatcctgaccatgttcaatcagatctctctggagaccgggaattgagggaaaagaaagcgggcatcctttggatgcccgcctttttactccttttccagctcatagcccatggccgtcagctcccgtcggatctgctccacatgggcggcgtcccgggtctccagcaccatggagaccatgcaggctcccacgtcggaatgctgatcctcccgggcatggttgatgctgaggatgttggcgccgctgtccgccaccaccttcaaaagctgcagcaggctgccgggcttatccgccaccttcgtgctgatctctgcgatccgcccggccttggacaggcccttggtgatgatccgggacagcgtggtcacgtccacattgccgccggagaccacgcacacggttttcttctccgacgtgtccaccttgccaaacatcaccgccgccaccggcacggcgccggcgccctccgccacggtcttctgcccctccatcagcgccaggatggcggaggcgatctcgtcctcgctgacagtgaccacctcatccacatactgctggcacagggcaaaggtcagatcacctggcttcttcaccgcgatgccgtccgcaatggtggacacgctccgcagctccgtggggcccccggcgtggcgggacaggtacatggacgccgcgcccgccgcctggacgcccacgatccggcagtccggcttcagctgcttcaccgcaaaggcgatgccgccgatgaggccgccgcccccgatgggcaccacgatctgctccacgtccggcagctgctccaggatctccaggccgatggtgccctggccggcgatcaccagcgggtcgttgaaagggtgggcgaaggtgtagccctgctccttcgtcagccgctccgcctccgccgccgcgtcgtcatagacgccgggcaccagcaccacctctgcgccgtagccacgggtggcctccaccttgctgatgggcgccccggcgggcatgcagatcaccgccttgatccccagccgggatgcggacagggcaatgccctgggcgtggttccccgcagagcaggcgatgacgccccgggccgcctcctccggcgtcaggctgcggatcttgttgtaggcgccccggagcttgaaggccccggtcagctgcaggttttccgccttgatgtacacgttctccccaaatttcggggccctgtccagcggtgtccgccgggcgatgccccgcagggcctcctgggcctcccggaccatatccaaagtcagcatggactcccctcccacgtctttcttatgcttcattatatcggcgtgcccggcagaatacaatgcacaactcctccaatgtttttcattcaatgacatcgtttttacagtttgtctttatacaaaggatatccatattctctccgcgggcagcaaggcgttcctccgcctgctgcggcacggaaagttttcaattcatctctatacaaatcttccgaaaattgctataatgaatcaaattttgtcgaaggaggagtgtccgtgaaaccgcaccggaaagcggcccccgcggaggccgcggccgctggccgccaggagatgccccgctgtgcccccaaggcggacagcggcctctcctccgcccaggctcaggccctggcggaggccggctgggacaaccgcccggtggagtctcccaccaaaagcgataagcagatcatccgggagaatatcttcacctacttcaacctgattttcgtggttctggcggtgtgcctgctgctggtaggggactggaaggacatgaccttcctcctcatcgtggcagccaatgccgtcatcggcatcgtccagcagctgcgctccaaacgcaccattgagaagctgtccctcctctccgccgcgaaggtgcggatcattcgggacggaaaggtccgggagctgccggtggaccagctggtgcgggaggacgtagtagagctcaccgccggctgccagatccctgcggacggaccggtcctcaccgggcaggtgcaggtgaacgaggccctcatcaccggcgaggcggacgccgtcaccaaggagcctggggaccagctgctgtccggcagcttcgtcatctccggcaagtgccgggcccggatggaccaggtgggagcagactcctacgcctccaagctgacgctggcggccaagaaagatgacggccccggcaaaagcgagatgatgcgctccctggacagcctgatccgcttcatcggcatcgtgttgattcccatcggcgcagcgttgttctacaaccagttcatcaatcaggatctgggcctgcagcagtccgtggtcagcacggtggcggccctgatcggcatgatcccggaggggctgttcctgctgacttccgtggccctggcggtcagcgtggtgcggctggcccagaatcggacgctgatccacgagatgaacgccatcgagaccctggcccgggtggacgtgctgtgcgtggacaagaccggcaccgtcaccagtcctcaaatgcaggtgcgggaggtggtgcccctggacccggagtcctgttccgacacggacatcaccgacattctgggtgccttttaccgggtgctggatccggataacgacacggcgaaggccatcgcggacaagtttccccgggggcccggctggccggaccggggagccgtgcccttcacctccgccaccaagtggagcgccgtgaatttcctggaccggggggcttatgtggtgggcgcaccggagtatatcctggggcaggacttcgccgccctggaaaagcgtactgccccctacgccgcccagggctgccgggtactgctgctggcccagtgcgacggggcggagatcgggcgcctccacggcgtggtgatccccctggccctgctggtgctggagaatcccatccgccccaacgctcccaaagtcttcgattacttccacacccagggcgtggatgtgaaggtcatctccggcgacaacccggtgaccgtctccgctgtggcggcccaggcaggcatccggaacgcagagcagtgggtggacgcccgggagctccagacggatcaagacatcgccgcggccgtgcgggagtacactgtgtttggccgagtggtccccaaccagaagcggaagatcgtccgggccctccagagccagggccacacggtggccatgaccggcgacggtgtgaatgacgtgctggcattgaaggacgccgactgcggcgtggccatggcctccggcgcggatgccgcctgccaggtggcccagctggtgctgctggacagtgactttgccgccatgcccaaggtggtggcggagggccgccgggtcatcaacaatatccagcgggcctcggcattgtacctggtgaagaacattctgtccttctttctggccctcatcaccctgttcgccgccttcccctatccctttgttcccatccagctgacgctgatctccgccctgaccatcggcgtgccctccttcttcctggcgctggagcccaaccacgacctggtgaagggcaagttcctccacaatgtgctgcggcgggcttttcccggcggtctcacagccatcttcgtcatcctctttgcggagctgttcgtctacaccttcgacctgacgctggcagagctctccaccatctgcgtgatcctgatggcggtaaacggtctcatggtgatctactacgctgcccgacccctggatgccaagcggctggtgctgctggtggccatgagtgcggccatgttcgtggcggtggtgttctatggggcgttcttctctctctcctccctgtcctttgcagcctggctggtgctgatcgtgctggtgctgctggtggtgcccatccagatgggcctggagtggtgctttgaccgctgcaccacggccctggaccgccgccgggagcggctggcaaagcgccgccgcgctccccgcagaccccggccggcgcaccgctcccggcgccgtcggtgatctttcccacgccaaatagagcggaccgtggaaaaccacggtccgctttcttcattgggtcagcaggcggagcatctcctccgccgggtccaccagcggcagccttgtccgggccgccagggcctccttaaaataggggaagtgcgtgcagcccagcaccagcgcctccatcccgccgtcggcaaaccacgctgccagcgccgccagacggtagcgttccaccagctcctccggcggcatccccgcctccacggccagcaccaccggcagcgcacaggcccccagcagatccagggcgggattggcctccagcaataccttctcgatgccggagagtccctgggcgttggcggcgatgactcccagcgcccggtagcggagcgccagccgccggtacacgtccagcggcgtcacgatccgcatccccgtctcctccgcaagccccgggaaatccactgccgcagacagggagttgcagtagacgaaagcccgccgacagccctgggccatggcgcccctcagcaccgccagggcctggcggcgcttgtccgctgccggggcgtgctgaaaggcagtctgctccctgggtccccgggagaggggaaacggcacgcccggcagcccccgttcctccagatatgccacgcccatccgggtgtccaccggtgtgccggccaatacagcaatgggtccgttcatggcgatcctcctctcctcatcccagcttccgcggaaagttgccgaatacccggacgccctcctgcacagtcaaaaacgcgtgggggtccacagagtgcaccatgtggagcagctcctcgatctcatatttggagaggcacacgcacaacacacggacatcgtccttggtgtaggcgcccacgccgtcccagtaggtcacgctccgccccagctgtttgataatgaagtccgccaggacgctctcgtcctcccgcgtgaaaatcagagcctgaacggtaacattctgctggtgcatcctgtccaggatcatggagtttgcgaagttgtaaatcacggagtaaatggcgacctccgggtcaaacaggatcaggatggccgtataaagcagggcattgaagcccagcgcaaatttacccaccgtaaaagcactgtcccgcttgctcatgatgagtcccagcacgtccagtccgccgccgctgccgccgcaggtgaggacgattccgctgccgatcccggtgaggatgccgcccagcaggcaggccgtcagataatcgtccacaatgggctgcgtgggaatgggaatgatgctgtaaaaaacagagtaggataccgtacagatgatggtccgcaccgccagtcccctgcccaggttccgatacccgatcatgagcagcgggatgttcagcagaaaatagaggacgcctgcgatgtcgtaggccccgaagctcacgcccaggaagtcctgcagcagcgttcgcaccagttggcagaagcccagcaggccgccggtgtacaggctcagggggacaatgaagagattcagcgccgcggccgcgatcagctcgcccagcacggcgagcaccagccgcaggattcggttgtgcagggtagtgtacagcatgggtaaaacctcccttgggagtgcagctcccttctgcggatatccatggtccctctttgataccgattatacggtgtatcccgcaaaacctcaagagggaaaattacagggcgtaccgcaggcagcggtacagccgctgtttagcccgcttcaccgtgcgggagacggtggagcggttcacccccagcttttgagcaatctgggacattttcagtccccggtcgtaatagaggaacaccatctcccgctgccggggcgtcagctcctgctcccgggcccggcgcaggccgcgccgcagccgctccagctgctcactgttatcctccgcatggtcccgcagccagacggtcatgtccccgatccactcgctgctgcgggcgtcaaagcgtgtatctctcatgtctgtgatagctcctgtcgtaataatgggccgtcagcgccgccagctcccgggtctcctgcagcagcggcgtcagctctgtgatccgccgccgcagaaggcggcggtcctcctcgtccttcagctcccgcgccgcctgccgcagctcgccgatccgccgccgcagggcggccgcgctctccgcgtagagggcggacatctccagcagcgtcatggcgccgcctcccttccccgcacctggcggaagggagccagctccgcccgggcgaacaccgggaggcaggccccacatacgctgctgccgttgcagtaccagtagtcctctccctctgtgatctccagcccgcagagcgagcagcgcagcgtccgccgtcggcgggtatgttcctttgtttccaaatgcgatgctcctttcctgtatacagatcccggcaagtctcatgtgccccgccggcaaaatgaaaaaaacgggtggaaaagcaaaaattttctgttgacaaacaggcgcttatctggtaagataaattctgctgttggaactgctggtgtagctcagctggtagagcagctgatttgtaatcagcaggtcgggggttcgaatccgtccaccagctccagttttaatatgggggaattccagagcggtcaaatggggcagactgtaaatctgttgccttcggcttcggtggttcgaatccaccttcccccaccaaaaaggtgcctgcaatcgcgggcgcttttttcattttgataaacaagatacttgtaaatttttatttattttacaagtatcttgtttacagctatacagtagcacaagtttttttgaaagtcaagtataattttacaagtttcttgtaaaattggattgacagcttccttgaaatccgataggatactgtcaagaacatcggaaaggatgggatccatggcatttggagaccggatcaaagcccgtcgggaggagctggctctctcccgcccccagctggcggatcggctgggcgtcacaccgtccactgtcagcaactacgagaccggtgtcagcttccctaaggaggagatgatgctccggctgttcgactgtctggagacggaccccaacaccttgtttcaggacagctttcgccgcggcgcggacgtcctgactgagcgggagcggcagctgctggagcagtatcgctccctctctcccctggggcgggagagcgtccagacgatggtggaggcgctgcgggcctgtcagcaggaatccgcagccccggagcaggagccccgggtcattcccctgtaccggacccctgcggcggccggttatgcggcgccagtgttcggcgaggatttcgactacctccaggtcacagacggcgtgcctcaggccgcagagtttgctgtgcgtatccagggggactccatggtcccctacatcccggacggctccgtggtctatgtgaatcgcgatcccctgaaggccggggacgtggggatcttctgcgtggacggggatatcttctgcaagcagtattacaaggatcccgccggaacggtgtatcttttctccctaaaccgggcgcgggccgatgcggacgtggtactcaccgccggcagcggccggacgctcgcctgcttcggccgggtgatcctccacgcgctgccgctgccggggcggacgtaacggagagccgggcgccgcctatgcggcgcccggctctcttgttcggcagtcttcaaacgatgaacccgccgtcggcggcgaggatttgccccgtgaggaaggatgccttgtcggaggccagaaaggcaacggcgtgggccacgtcctccggcgtccccagccgtcccagaggcgtctgctccgccagatcccgcagggtctcctgtcccagaacctgaaccatgtcggtgttgatgacgccgggagccacgcagttgacccggatgtgggagggcgccagctccagcgccagggaccgggtcagccccacgagagcggctttggtgcaggcatacgccacctcgcaggaggctccccgcagtccccagatggatgagatgttgacgatgcagcccgccttctcatggagcatgtggggcagtactgcctggatggtgttccgggcgccgcccaggttcacgcccagatagcgattccactgggcatctgtgatatcctgaaattggatctgccccgcaatgccggcgttgttcaccagcaggctcacgggtcccagctccgcttccgcagtgcgaaccatcgtctccacagccgcccggtccgccacatccgcctgaactgcaatggcatttccaccatggttccggattttttctgccagcgtctccgcctcctgccggtgcgtcaggtaattgatacagacagcatgtcccgcctccgccagctctgccgcaatcgctctcccgatcccccgggaagccccagtgaccaatgccacacgattcatagtgatcctcctgtcatagtgctgtcagcagtataacaaaaaaaacaggatcgcgcaagaaaagtgttgacaaaaggtgcgttttcgtgtatcctatatacgttccgttttggacgattagctcagctggctagagcacctgcttgacgtgcagggggtcacaggttcgagtcctgtatcgtccaccacaaaaagcaccgttttctgatgaaaacggtgctttttcgtaactttttatgcaatttactcgagagttatgtaaccttgctgcgcccctgaccacacggccagccacagtcagaaaaaatttaggcctccaagggcgattcgccctcggggacccgtttgttcaacctgtcagtcctgcctgcttccgccgctctttcttagaggcgatttctgctttcatctcccggatcatatgggccagcttctcttcgcactccgcctctgtatgggcgtagacgttgcgtgccattcgtttcccgttgattttcggggagtagcggccctcccagaggtgttcgctgatttgactgacacaacccgttcccggcttccggtatttcctcttcaccggctggaagtccgtttttgcgacttttggcttagccggggaggatgcccgacgcggtggttcgatcccggcgatcccccgatcgatgctggcggcggcattctcccgcatggtgtcggtgacatgggcatagacgttcagtgtggtggcggacgtcacatggccgatgatggtggacagcgtcttgatgtccatgccatgttccagcgcgttggtggcgaaggtatgccgcaagtcgtgaaagcggatgtgcttgcagtccgcccgattcagaaccttggccagcttcttccggacggcggccgggtccagtggggagtcctcctttttcggagaagggaacatccacctggaacggatgctctgccggtagtctcgcaggacacccagaatgggggctggcaggatgatgctccgacaagagctctttgtcttaggggcggagatcaccagttccctgcgtacccgctggacctgccgttcgatccgcagtactcctgtgcagagatccaagtcatcccattggagggccaggatctcgccccggcgcagaccagtagagagttctaatagcagaagctcatagcagtcgttctcacgggcctgtatcagcagacgccgaatctcctccggagacaatacctgcatctccttcggacggagcgtcggcgtcttacaggcatcggcgggatttttcaggatgaggccctgttttaccgcctgatccagcgccgcccggcaggtcacatggcagcacttcaccatacggtcagagagtccggagccatattgctccacagcctggaggcggccaccctgcttgagttggcggtagaactgttgaaggtctgctgcggtaagcctgttcagcgggatttggccgatttccgggatgatgtgccggtagatgcggttctcgtagtccgtttgtgtctttgctccaatcgtaggcttgcattggttctggtaccagtgatccagccatgctccaaaacacatatcggatgacagtcgttccagctctactttcttcaggctgtctttcaggactttcagcttttgtaggcactctttcttgttttttgccagcacattctttgtcttgggatagccgttgtcatcatagccaatgactacccggccctcccagcggccgtcttttctcagatggacgctcccgtcccctcgttttctgcgttttgccaaggtttcatctcctctcccaggatttctgtcataaaatctccgacgatttcggcggcggtgcgctgcatatctccagtgacatgggtgtaggtatccagcgtgaaggatgcctttgtatggcccagaatgccggacaacgtcttggcgtccacgccggaggccagggcatgggtggcgaaggtatgccgcaagtcgtggaaccgaatgttgggcaggccagcggagtccagcaaggccttcaggtggccgtatgcggagcggggattggtaggggattcgggcttcagcggattcgggaagatccactctgaccaggaatgctttttgcgttccgacagaagctgggcagtacttgccggcagcaggatatttcgggtccctcgcccggtcttggtggcaccggccaccagcctgccgcctttctccgtgtggatggtccgccttactgccagtgttccggctgcttcatcgaagtccgcccacatgagtccgcagagctcaccccgccgcagaccggtggtcagctctgtgtagaagaagtcgtgccagacggcgtcgtgtttgattgcctccatgaactgttccagctggtcatcattcaggatctgcttgggtttgggatttgctttaggaaccgggatattctcggtgggatttttggcaatgatatgggattccttcgccgctttcatggcttcgtggaacatggtgtggatgctgtgtaccatactgccggatagctggtgaccgtattgagcgtgttccttgacacgcccccgtgctttcagaacttcgtacatcttctgtacatccgtcggggtgatttttgaaatctgcttatctccgaggtatggcttgatatagagatccgcgtacctgcggtatccgttcagtgtgctgggccggatggttccggccatgatcgcatccagccagtagtccatccattcgttcagggtgagcttgctgtcctcggtcaggtcaacgccctggtaggcgatgatctcctggcggagctttgcggtcaactctttttgcgtgggtgcgtagatgtagcggaagatgctgtcgccgttttccttatggccgatcacgatgcggccctcccaacggccatcgtcctttttgcgcaccatgccgtcaccggacggcctgcgtttactcatttgaatcgcctcctctgtaggaactcttctttgtttacaccatcgcagtttttgacggtattgttagctgctttttctctgtgaaaacttttcgcaggcctgactcgtcttctgcctcaaacctgtggtaaagggctttcatgtagtcatgcatggtgtgccacctcctgtcaacgacacacaataccgcaaccactgctgaatagccatcccaaatgacaacaattatcagaaaattatcaagttcagagtgaactgcaatgggccgcatccaatttcggatgcggcccatctgaactcctcttatgcatagggattatgcgctgtcggattgcctacgaacatgtaacagaaggctctaccgttatcgatggtaacgccgacgccaacggtatcgcaattcgggtcaatcatcgttgccagatggccgggagagttctcccagttcgatacagccttttcgggaattctatcgggggtcgtgacggtgaacaccgtcaggttggagccgaagccgtgggggtatatccgtacccagctgacaattcggaaggggtgctttcacgattgttttgcgccgcaacggtcgattcccattttgatttgcaactctgtttgtggtatgctacaatgatctccaaagataggaacgctgatttccagtacgatgctatcgtatagtgcatatactgtatttacagatcgagcggggaggtctttcgtgtgagcaattatgagttttccctcagacaggaagtcctgcttgaaaagggggccgacattctcgggtcactttttcattttgcaaggaataaccatatttctccctctgacaaaaaagatccagttaatgttgtttacggtttggtatggaacgccaagagcagcatcctgggtgcggatactgaggccgaattggatcagatcgaaacgcagtttgattttgctcgtaaattttacgctggtattgaggcgtgagcaaaatgggcatcctgtgatttccggaattaccatttgggatagaacaccgacaaaaatttacgatagctgtgggactgcggagtgtccatccgaagtattacgtcaatattggaacagaccttggcctgatgaggaacttcaggatatgcaacgatctatccttcgactgcgccttaaggaggaggcctgtcagctgaagcaaagcccgtctatcgacgagttagaacgaagggtgcaagaggcggctataggccctggacttacgttcaacacgatgatgtgatggactgaccgtgctcttcgctcagcaagaaagctcttttgagaatggcgtttttaatcaactgaaattgtagatagctctcccagcaggagagctatcttttttgccttatcaggcttcctcctttcatgattgttgagttgctttgatgattttttgcaaacacaacatgtaaaggacccagaaagaaaggcactaaaggattcgacgttttcagacttttgcgaaagcacgcagctctaatgcatcgtcatattccaactgccatactgctgctcctcatgatcgtcctctttgtggccatggacgagacgcttctcccgcagctcttgacggcgcttgcggtcgatgtgggtgagccccgtgccgctctgcggcagggagttgtcctggaagatatttgccatgtgatggagcagtctcgtcactgcaaggaacacctccggcgctgtcgaagcactctgcctttccagaaggcactgcgcgtaactgtgtccttgctccgccgcctgagacagccattggatgcccgcctctttgtcacgctcgaccgccttcccttggagcagcagctttcccaacagatactgcgcatggagattgccggcctgagcggaggtatagatgtgatccatagccttgcgggtatctcttcttactgattctcccttcagatattccttgccaaggcggtaggatgcatcgtggtttccgttgtaggcagcgtactccagccactggatgccaagctcgggatcatggacgctggcatcatcagagagatataattttcccaaagcatactgagccgctacatatccctgctttgccgctttgtcaaaccagtatcgggccatcacccagtccggcggcagcagcgggccgtcccgatacagttctcccataaaatactgcgcatggatgtcaccgttctccgcaagttcccgcatactttccacggcatcatcccgttctgccagtgacgagtattcatcctgaacgtccatacgaagcgtccggaagtcccaagacacatctttgccgttgtccacctcatcgccctgacgcaggtccaaggtttcgtcctcaaaggtgattttccccagccggatcgtctccgcctcttggatgaccgcattcttgatttggcgaaactccttctgccgggacagcggcgggcggtgccgctccttctcagaatagaaatcttccacctgaccttgcagctgccaccactgttcgtagcattcggccacggtcgggagctgctccatctggtccacaatctcatctaccagcgccttttgcttcttcggaagatagccataggacttctttcccttgaccgtttccaattgaagtgcaagctcttgcatgagccgctccgcctcggggtggtcgcagatcctggttcgcatctgctggaccaactcccgcatggcctgccgcacttcccgcaccaactggtcacgggaaaccgttttctgctcatagaggtggagcatttcttgctggaagatatcgttggtgagcttggatttgatttggcggatgccgtcctgagatagatacgcctgtcccggctttacggaccatgccatcatgtgcacatggggatggtcgccctcatcatggaaggcagcataccagcggaagtcctggggcgggatattcatagcggcggcgatgtcgttgcggtgggcgcggaggagattcctccacgccctggcattgtcgtagcccaaccgttctgcgtcctctcgcttcagggagatgatgtgtgtccacacgttacctgtgtagctctccagttccgccatggccttgtccagctccacgccatctttgtcaccgaagagaccatgggagcccagccgttctgcccttggccgtgttgcgatgtacttcatgtagccatccgatttctgaacatcgctccagttttcctccaacgcctgagagatgaacgccgaagcgttggccttggtggggtgttcttggtagtcaccgtactcacccatctcctttgcgtcaggaaaatccttcaccagttttgcgataagctgttcctgcttccttgttggcggacggtcattctggatcaactcgacccgctcacgggtggcgatgtatctcatgtatccgcctgctgagttgccgcctccgcacttgatgtacgggcttttgacgatcagtcttgccatccgtcatcgtcctcccaggattcccgcacccgtctttcgaacgagatgcggccattggtctgtttcacatttcggacgctctccgcacggcgtcggcgcaggtcctcttcactgaactgaaaactgtccgcaatgatcccggacagcatatccaactccaccgcctgcttgtaagccagcgatgccattttgttttccgtttgccccacccgaccgtccagataggactggatggaggtggggaggaacagcccagcgttgttggcactgagatagtccaggtagaaatcgatggcccgctcaatgaatccggtgatgctgcggctgccatcctcctgatatcgtcgctccaagcgtgcctttttctcaggagtgagatagagggcaaatttttctttcttgctcaaaatgagctcctttccggggtatgacccctacttttttcttgtgggtgtaggctttcagggataacgaccgcagaagtgatagcaccccttcgattttgaccccactttggaactccctgaaaaccccgtaactgcccgcactgcgggcagaagtgaccgaacagagcgtcgcacttgacgcctggtgtttatcctgcttcacgtcatcgctgtctccatatccctcgcttccacccaaatgggcgaaaactcgttcatttcgctgctcctccttttcccaccgaacccgcttcgctgggtttcggcgggagcccttattttgtcctccgtcagctctcgaaaggcgacccaaatccgttcgaataggcctggccggtatctgttctcgctgctcccggcaaagccgcacacagcggctcacaggggcgaacacggccttgtttttgcagttcctctgctacccgctgacgctccgtgacttcctccagtttcaccatctgccgctcgtaggaatggtcgacggcttcctggatcggcaggatggtgtagcagttgttgccgttccacttcattccctggcggtcgaaatagctggtgcgctctactgtgataaactgcctgtcctccagtttggcgatgtgtttcatcaccgtgttcacggccagccccacagtggcggagatggtgttgtaactgggatggcattgatggctgctgcggtcttcgcagtagagcaggtaggcgtagacggtgatcgcgccatgccccaggtccagggaaaagatttcgttagggagggagaaaaactttcctgcgtgtttgcgactgaataccggaaccatctgcggcgagatcagatttcgtttgaccagagtatccaactgcttttctgccatgtctggactcatgtggagcagcgctgcaatctcatccacacttggaacggcgccacccctatggtggctgttgagatagcagagataggcgaggatactgaaggcggggggcggaagtttcagcccccaaattttgttgggcagcgagaaccgatacgctttcgcgtctttctgataggtgagcgcagtcattcgcggacacctccttccgtgtgcttggtgacccactggatgaacgcttccttgggaaccaccatcctgctgccgacattcagcaccgggaagtccggctcatgcatcagctcatagctggtggaggacgatacccccagcaccttcgccactatgtcggcgttgaggaacagaggcaggtcatcgtaagagttgtactgtgactgtttcattttcgatttctcctttgcagaaagtaaaggcatcagcggcgacgctgatgcccttctgcttgtattgtgtcggagattttgataagataataaaaagttgggacgaattattttccaggggggacaatttatttcgagggaggcgagcgcatggatggggatatcgttttctatatccacggtgatacgatcgagtacggtggggaattattttccacaggcgaactgacagcggatattttgaacctgtcactgaaggactatcagtgcatccataaaaacgtccagtgcatgaaggaccttgcggagcagtacgagcgaacccaggaccgggaattttggtggaagctcaaccaccagttcgtggctttgcgtaagcggatgatggagttccgggtgtttcagatcctgcttcgggatgacagcaaatttttcgacgagacccagcagtacaccgagttccgctccttgctgccggaagaagatctggactatgaggatttttccatagagcaatggggagacatggcggagcaggcggagacaaccggccagatcccagttccgcttctgattattcccggagggcggaaaacgaagtggagttattatcggaagcagatgaagcgctatgaacgctatctgggcgacgtcgcgtgcttcaatcctaccatccataacttcatccacttcctcctcgccaagctggagcataactccccggagaactatgccgcctccctctatcagctctacaacgatgagcggctggtggagaagctgatcgtcaatcccagaagcctggagcagccgttttatcagaaatatgaccactgcgtcgtgagctatgtgccgcgggagctgccggacaagcgcttcgccatttgccaggagcacaccaccgacagcttgcagatgctgctgaaggcggattacatgacggcactgaatgccggacacaacatccgccagtgtgttgtctgcaaaaaatactttctggtgaagggcggcgctcatgcactatattgtgagggagcatgtccccatgcgccccagtatacctgccgacagttcggaacctacgaagtgcagaaggaactggctcgggatgtgccgaagctccaagcgaagctcgccgcttttgaacggatacggcaggaccaaaagcgcgacgttatcacggcggaggaagcacggcggctgaaggatacggtccgggacatgctgttcaatgcgctcaacaaggcagatgtctctaacgcggactttgagcggtccatctccagtgagagactttacccatactgcggtgttacccggaaggcgaaacccagagggcgtccccgaaagggtggtggggacgcatgagcgaccaagaattgctggatcgaatcgcgcagggagatcaggccgcgctgacggaactgtgtgataggtatgctgaattgattcggaaacgtgcgcagtggatcgcccgacaatacaattgtctgcgccccggcagtcacggaggttggagcgactatacgaaagaaacgctctccgaattggagagcgttgggatgctgacgctgatcgaatgcgccatgaatggcggctatgatagctccaagggagttttcggaacatacaacgtaccatttctggacggcgcgatgcggcggcacctggaagccagcatgggtaccctttccctggaccgggacagcatggggctggtacgcaaggcgcagatgctctatcaccgggatggaaaagagatgagcgaaatcgcaggggagttgggtgtttctttagcggaagtagccagggcggtagcctatcccacgcatttcttctctgtttatgacttgccaatcccggaggaggacggagatatttttgagtacctcatgtctgatctgctgtctgcatctgcggaggagattgtccttcgggcgcttacgatgaagtctctgcatgagcagttccaaagcctatccaagcgggaacaggatattctgggcaggagcttcggcgtttttggttactcaaagacagacctgcgggagatcgccatccgaaacagactgcgggaggacggcgtggagaaggcgaagaaacaagcgctgaaaaaactgcgggaatggtgtctggacagcatggcatggaagctccgccgagccagacacatggtggaccgtgcgatttcactggtgccaatgcattgaatggagttgagaccagaaaagagctttctttgtcaacagtatcgcattattaagatagcgaaaacaattgacctactacaactatgtggacctgaatggcgacggcagcaacgaaatcttcgccgtagctgtggggccttacaccagcggcagcggcggcgattccggaatgtggctgatcccttacgcgggtatgacggtctcccagtccttcacgctgatcagaactcccatcatcgtcagcgataccacgaccaacggtgcccatgagcccatcctccagcgcagcggcggtggagcggagacggaatatgtgcggctggtctgctcggacggcgtttacagcaatcccgctgatgccgaagtggtggaagatttggccgctgttaccggaaaggccattatctccaatgacctgactgtggatatgcagtccggcgactatctgacgctggcggatgctgccaaggcggattaaagtaaatcgactgcgaggaggaattttgataaagcggatactaagtttattgctgacggcgatgctgctggcctgcctgtccagttctgcgtttgcggcagaaagaaataaccccatcgacccttggacgtatcaaagtcttctgggccgtggaatggatgtagactggtgcaagaccagacagggcatggagacgtatgaccggcagattgtggagaatttccgggatatggggctctcccatgtgcgcatccgcgtgaaggatgatgccgacgaacagctcttttccgttctggaccgggtaatcgatgactgcctggactgcggcgtcattccggtgctggcttatcaggcggatgacatgaaaaaccagcccacacagaaaaacatcgaccgggtggccgactggtggcagaccgtggccgaacggtatcgggataagtcctatcggttgtccttcgacctcgtcattgaggtgacgaacgctctgaacgataagcccgaacttctgaatgatatttacgagcagttggtgtccgtggtccggaaatccaatcatgaccgcatcctgatgatctccccccgcctgcggtccgattcggcctatctatctgatttggagatcccatctgatgccaacggatacctgatggcggaatggcatttctatgcggcaggtccgtccaagaccaatgagaaaaaactgtggaccacaggcactccggcagaacggcagttggtacagagtaagatcgacaaggcgctccaatggcagagggaaacgggcatccccacctgggtgggcgcctggatgccgggaaattacaacgacggaaatgactatacgctggatgaacagctggcattcgcctccttcgtggcgcaggcactggaagatgccagtatcccctttgcggtaaactcggatacaaaattctacgacagagtggaaaaacgctggtattctgagatgctgccgctgacaatggagctgtttcagccggaatcgctgcctttttccgatgtgccggaaggggcgtggtactatgattctctcctgtatgtgtatcaaaacgggatattctccggtacttctgccacgactttttcaccctatcagaatatgacccggcagcagctttggacggtgctgggccgtatggcgggggagaaattgtccggaagcggcgtatacagcgccgccagatcctgggcgatccgggccggggtgtctgacggttctgatcccacaggtacgctttcccgacagcagctggtcatgcttctctggcgtttcgctggggagccgacgtctgtccaagacctttccggtttttcggatgcggcacaggtttcctcctatgcgaagaaggctatgagctgggcggtggaaaatcagattctgacggggagcggcggctgcctgctcccacacggaacagctacccgcgcacaggtggccgcgatcctgagcaggttcagcataggctcgtaaaaatgcgttcaagttggttgagacaataaaagattccttttcatgtgttggtgttaagctttcggaaaatcgttcgtcaaaataacggaaagggattcgcttgtaagttagtgaatccctttctgttgcccgacaaactggaattgttatctttctattgccttctcaatcatctcagttttttcagcccttcccatcagccgagatagtatttgcaccataacgacggtgattgtagcgggataacttctgtttccagcggcattttctccacgatttactctttgcgtagagcacaatcataaacctttccatccttcacgattgcaaaaccagccatcacatcgacctcgacagaatcaataaagaactccataaaggtttttgcccggtacatagggtttggaattgaagcagatggaaaactttcacccatttccgataaaattgtgcggacgcattccgcatcacagtcagtgaccattaaatcaatgtcgtggaagtcggaggtgatgcccttgaaatacagcagcatggatgcacccaaggcccattcgacacctgcctcgttcagtcgatgtacgattcgcaacagcaactggattttttcttgtgttttctccatacggttctccccgaattatcagagcggctgcatcatttcaaggataatgccatccgggtctctgaaataaaaagctcggctttccccaaattcatttgctctgaaatcgaaatattgcggctcagacaagcactccacatgattttcgatatcatgaagatctggcgcacttagcactgctgataataattttggaaagttttagtgtgagaatacagattttgcctcggtgatgaacgctttcaatgaagggttgtcttgtatggatttatagtagatgccaaaagaagttggattgacccccttgatcgggatttttacaagtcgatggtttacggggatcaaaacctccggaagaacagaaattccttatccggaggatactaatagggagaactatgcgcgtgaaagtgtggaatgaccatgggaatcccgtcaaactgctccacagcggcatccataccgtagacggcccggatgttctcggacgtcaccgcttcccggccaccggaggcatacacggtgccgtccttcaaaaacaggaaacggtcgcagaaccgcagggccaggttcaggtcgtggataacaaccagcacggcgatatggtggccgtgggcgcagtggcggatgagctccatggactcgtattggttgcgggggtccaggctgcttgtgggctcgtccagcagcatcagcttcggctcctgggcgatggcccgggccagcatcaccttctgctgttcgccgccggagagctggtttacataccgcaggcggcagttttccattccaacggcccgcagggcgtgctccgccacatcatagtcaatgtcggaggggccccatttcatgtggggcttgcggcccagcagcaccgcgtcgaacaccgtggtatgggccagctcatttttctgggctacataggagatctgctgtgcctgctggcctcgggtcatttgagtgacaggggtgccgtcaatcaggacgctgcctgacgaggggcggcggagacggctgatacaggagatcagcgtggactttcccgcaccgttgttgcccagcaccgccacgcactcgccctgctccagagaaaaactcacgttctgcaaaatggggcgggagccataggcaaaggagaggttttgaacttctatcatcgtagcgcctcccctctgaaaatcagcagcaggaacagcggcgcccccaggagggacgtgatggcgccgatgggcagaatggcgggcggcaggatgaccttcgctgccaggtcgcccaggaggagcaaggtgctgcctgccagagcggaacagggcaggagaaaccgataatcgctgcccacgaaccggcggacgatgtggggggcgatgaggcccacaaagctgacaatgcccacgaaagccaccgccaccgaggcgatcagggtgcaaaggcccatgctgatatagctcaaaagatccacgcttactcccagactcttggcggtttggacgccgctgctcagcgcgttgtaattccagcggttccagaggaagtagaccagagccgccaaggtgaccgcgtacatcagccgaatttccgaccagccaggacggcccaggtcgccgaaggtccagtagaccacggtggacagctgcacgtcatcggcgaagtattgcagcagggtggtggccccggaaaagagagaactgagggccacgcctgccaaaatcatggaggagggagaggcagaccgcaggcggcacaggataagaatgaccgccgttgtggcaagcccccccagaaaagcacagagggtcacggtgccgggggagctgatggtgacggcagtacccgcgttggcggcattttgggcgccggcatccagggcgatgatggcgagggccgcgccgaaggcggcgccctgggatacgcccagcgtggaagcagcggccagtggattgcgaagaacgttctgcatcacgcaaccggacaacgctagggcggcgcccaccacgatagccacagtgatgcgaggcagacggacgtggaatacgatggctcggctctgggctgtgccgccgcctgccagagtgtccgccagctccgcaagggaaagcccggcggagcctgtggtcagggacagcagggctgccgccaataccgccgccagcagaacaagggtcacaagccgcttccgccggagaaacaggcggtagctgtcaggtgtcgccgtatgaagctgttcactgtgcagatccaagttcaatcactccaaaggtgaggccgttggccttcatgtcgttgtaatagcggcgtcccagcaggaattccaggatatcgtcggccttttcggcaatattcacgtcatcaaagcgctcaggatagatgacgctgccggcatagtaggcgtcagccagggcgtaacccacgttggtggaatagttgttgaaggagacgcaggcgtaaaggttgccctcccggaccgcagtcagggagtcaaagaagccgggattggtctggtattcgtcccgaacaaggctcatgttgccggggtccaggaaaatcagctccgggtcccaagccaccacctgctccgggtcagcgtcaaagtagccggtctcgcccatctcgtccgccacgttgttagcgtggatggccataagggggccgaagttggagtaagtcccggtaaagccgtgagcgccggagaaggtcacggcgccggcgtaaacggcaggcttgccttcgtcagggatgtccgccgtccgggcgtccaggtcagccttgcagccgtcgatgtactgcaggacttcctcgcaccgctcctgaacccccagcacctcggcggccacccgcatggcggtgtaaaagctgtcgtcgatgaagttgatgctcttggcccggatggacacgcagggaatcccggtggactgcgccagatcttccagcgcctcctgggtatagccggacagaatgacgtccggctgcaggcggatcaactcctccacgtaggcggtgttggcggtgccgccgcccttgccgatggagggcaaggcgtcaaaggtatcgtgataaacgtaggcataatcccggagggtggaatccgcatattccttgtcacagtcttctacgcccaccagccggtcagtgcattgcagataggtcaccatacgcagggcaccggagccggtgcacacgattgctttaacttcagcgggaatggtaacctcacggccgaaactgtcagtgacagtgcgggcagcagaagactctggctcggtttcttgggcggtgggggatttttggctgcaggcggccagagacagcagcagggcgcagaataatagggcggaaactatttttttcataaaagtgattctcctttatcggtcgtagggatggaaacagtgcaggcagaccaccttgccgtcctgcagacgggccatgtgctctgctacgccctcaccacagcaggcacaagtgagtgtggtgaagatgcgggctttttcaggcagaggctctttgggcacagtcacgctgaatagctcttctaatggtgcagtataaatctgctgcttacgttcctcacggctaaggggtgtctgattccgcttggcaattacccggaaaccttcaccagtggcacggtcaaagaaggtataggcggtttttccagtgcagtggtagataaaattccccttgcccagagtacagcccagcagagcctgaattgcatcgccggggcaggcgtcagtctcagcgatgcagaccaactcctcatcgtgggcggacgtccggcccagacgtagccgtacaaactcgcacaggcggacgcccaaagccagaccaggacattcatggccatggaatgccaccgccttttcccacatagccttatccattctgcgatacctccccgcggatggcggacagcacgtcctcccagaccttctggaagggcagcccggcagttctggcggcagaggccacatcctcgtattccggctttttccggtggatgccctcgccgtcggcgcacttgacgcggatggggccgtaggcggtctccacggttttgacagagggcgtcagaatgtactttccgcaacggcgggtgcggacgccgttggtggtggtctcccgcaggatggcgtgggcgatgcgcccttcgtccctgggcttgcagagcacggtgaagctgacgccggcccgaccctttttcatggtcaggggcgcgcaggagatgtccagagcgccctgggccagcagttgctctccggcaaaggccagggcctccgccgtcatgtcgtcgatatggcagcacagctccacgatctccgcctgctggggggcgccgctttcaccccaaaaggcccggacacagttggcggcggggaattcctttttgcccacgccgtagccggtcttctccagagacatgacaggcatggggccgaagctctcagcaaagtgggtcagcagggcggcgccggtgggggtacacagctctccccggatgtccccggtgtagcagaggacgccctccagcaggtgggcggtggcgggagcgggcaccggaacgatgccgtgggcgcagcggacttggccgctgcccagatggacgggggatgccgtgatgtggtcggggcgcagcatatggaccgccaggcaggcgccggtgacgtccgccaccgcgtccagagcgcccacctcatggaagtggatcttctccaccggcatcccgtgggccttggcctcggcgtccgcaatgcgggcatagatggacttggcggcatcctttacctccgccggggcatccagggcatccagcagggcggcgatgtccgccggagcggtgtgatggtgggtatggccatggtcatggtcatggtcgtgatgatggtcatgcgcatggctgtggtcgtgctcatgatggtgttcatggatatggtcgtggtcatggccgcagcccagagccacatcgtggctgtgctcctcctcgccgcggacggtgacgtccatgtgggtgccggtgatgccgcaggtaacagcctgccggggctgaatctccacgccggggaacaggcggttcatggtctccagaaaatcctgcttttcggattcgctcatcagctcatacagcgccgccatcagcatatcgccggcggcgcccatgttgcattccagatataatgtcttcattctttcgcactctccatctgattgatccggccggccaagaagcccgcgccgaagccgttgtcgatattcaccacgctggtcccgctggcgcaggagttcagcatggacagcagggcggagatgccgcccagggacgcgccgtagcccacactggtggggaccgcgatgacggggcagtctacaaggccgcccaccacgctggcgagggcgccttccatgcccgccacggcgatgaccacccgggcgctcatcagcggctccaagttgcccagcagcctgtgcaggcctgccacgcccacatcgtaaagccgggtgactcggttacccagtgtctcggcggtaatggcggcctcctcagccacgcccatgtcactggtaccgccggtggccactacgatggaaccatgtcctttcaccggctctggaagggccaccgccaatttggcgagaggctcataccgcagcgggaactgctccgccaggtagtccgccacctcctgcccaatgcgggtcaccagaatattgcggcttccccgtttctccatggcggccagtatgccgccgatctgctctttggtcttggactggccgtagatcacctccggcacgccctgacggacggcgcggtggtaatccaccttggcgtaacccaggtcctcaaagggggccagcttcaggtgcagaagggcatcctccggcgtcagcgcaccggactgcacatcctgtaggacagagagaatatcgtgcttgcttgccacgtctgtcactcctttcagtcgctgttttttcgggccgttagatccagagagaacaacgggaagatggggcccagcccggagcggatctcatggcgcattgcccaggcatcatcctgctggtcttccgttacctgaataactgccgcgcctccgcggagcctgatgcggaaatcccggaagcccatggaggcaagaaggtcctctccctgctccaccttccgcagagcttcctctgtgatgggagtcccggcggggatgcgggtggcaaggcaggcgtaggagggcttgttccagacgaacaggccggcctccctgcacagcgcacggacatcgcctttggtcaggccgcactcccgaaggggagagcggacctctaactcccgcagggccttcatgccggggcggtcacccgcgtcatccgaggcattggtgccatcaatgaccagggaatacccatcggacgcgccctgccggaggatggcagcaaatatcctgtgcttgcagtaatagcatcggttcgcagggttagctatcacttccggatgctgaaagatgtctgcctcaatcacagtcagtggcatgccgcattgtgcagcgacctgcttggcgtcttccagttcaaatgcgggctggaatgcggaatggacataataggcacgccagtcccggccatatttcatggccgcccagaccagaagggacgaatccactccgccggaataggccactgccccgcgcggattttgctcaaaaaaatctgataactgcatattgcacccctaaaaaagacaataggaaggtatctgccccctttgagagggcaaataccttcctggcatttagtttcgtcagttcttttatttgataatggaacggtaagacttatacagcttctgccgattcatccggcttctgccggattctaagtctgtaaggatgtaactgaacaatggatcgcaccactaacacagcgctttccaccaatttggacatcgactgttcaggaacgccggcaatatagttgtcgcaaagattcacgggaacaaaaatgcgctttgcggaactttgtccaacagcaagcgccatcgttggcgtaatctctccgtacatggaatccgcgatggcgatgccagaagcgccgacaataatatccgccttgcggcaattcacaacaacagcattttcaccagtggcggcatgttctgcaccggctttgagcatagcactcgttgctaatgcattcgtgccaaccgcaataatctcagactctgggaaagcagcttttaatgcagacaccagttgacgcccaagtccaccccctgtccatcaatgacaagtattttcatgcagttgcaccacgcttcctgtttcgtagaatatcgtcaaagtttcttgatatgttaagtatagcatgggataaaacaaaaacaaaatgctgattttgcatggattttacagtttttaattccgcataggaatgtcatttattccaagtcctacccaattttactgctctcctgcattctcagattcctgtttgttttcatataaagtactacagaaataagaagggcaagcatatctgtaatagtctgtgcccaaataacaccatacattttaaaaactgcattcatgagaagaatcattggaatataaatgataccctgccgacaggcagaaataatcagagcttcttttcccatacccatagcctgaaacacataacatatctgaaaattgaaaataacaaaaggcatcgcagtgcaaacgatccttaaaaaatccgccgcaagtactatggtagtgcgttcattaatgaatagtcgaataatctgcgatggtaacaattcataaacagtgattaatacactggcaaaagccatgctgaaaatcattgcacaccgaattgtttgtctcatgcgcgaataatttcctgacgcataattataagccacaagcggcaacattccttgacctattccaatggccgcgctgtatggaaattgatatacgcgctttataatacccgctgctgccaacggaatatccccatagtcagctgccatccggttcacaatagtattcgatacacaggtcagcatcgtgcccaatgcagttggaatgcctactaccaaaaccgagaggatatgtttcttgctttggaatattcctttcagcgaaaggcaaagaactgtcctgtttttcaggtggaaaaagcagatcattaaaaaaagcgttgaaaacacatttgacagcatcgtggcaaccgccgcacctgtcacttccattccgggaggcaaaagtccaaacataaaaacagggtccagaatgatattcagaattccacccagaccgatcccaagacttgcttgcctcgcatagcctacgctccgaagaatatgggcggcagttatgctgagtaccgtagggacgccacctacaataattgcccatacggcgtattgctgtgcatatggcaaagtatcattactggcccccataattctcagcaatggctccatgaacatgaatacccccgcagaatacacaagtgacagcaagagagccccatacacactaaacgcacaaatatgcctggcactttctttctcgaactttccaagcaatctggatatcaggctcccgccgccaatgccaaataggtttgcgattgccgtcaagaataagtggagaacaaacgccagtgatagtgccgctactttatatgggtcgtttgtttttccgatgaaaaaggcatctgccagattgtagaccgtggtgattagctggctcaaaatcgtaggcagggccatagctgccagagcctttggcacaggcatatcctcaaaaatactctgatcgatgtccttgttcatcctcaacctccaataccagacaatttggtcattttatattataagcaggcagctaattttggacaattctcattatgaatgagaattacccgatctcatgcaacgcaggaatctatcagcaaaatcgttttttccaagctgagattcatagaaaacgcctatcccctacccgcacatattcaggaattcgtttacctgccctccacagctaccagtattgttctgaaccacaccaaaacagtagtaataacatcggtttgcgagattgactactacttccggatactgaaatatgtctgcctcaatcacggttgggggcattttgcattgaatggcgacgttcttggcagtcctccaattcacatgtgggttgaaatgcaggatggatgtagcaggcacaccagtcccggccatatttcatagccgcccagaccagaagggatgaatccaccccgctggaaaaggcactgtccatcatggattttgttcaaaaaaaccgataactgtatattgcacccctaaaaagacaacaggaagatatctgcccccttcgagagggcaaatatcttcctggtatttttgcttcatcagttcttttatttgataacggaacgataagactcgtacgacttctgcgctaaaaatgcataagcaaaaacagctcctataacgcagatttaatatgctaaatttggtagtctgtgtgcagcagatgatgggccttctcccccaggggctttttcaggtaagtccggtacagctcctggatatctgggttctcgtgagagaagcggatatcggccttggaatccagcttccacagctgactgccgcgggaggccgccatctccacaccctcgtggatgggctgaccgccgccgccggcgcagccgccggggcaggccataacttccacgaagtcgtagtccacctcgccgctgtccacggcctccatcagcctgcgggtgttggccaatccgctgaccaccgccacccggacctttccggcgccggggatctcaaaggcggcttccttccagggcttgctgccccgcacctgctcgaacgtatccgggtcggggttcttgccggtcaccagatagtaggcgctgcgcagggccgcgtccatgacgccgccggtggcgccgaagaccaccgccgcgccggtgccgctgcccagggggctgtcgaactccgcctcctccagctcagcgggcacgatgcagtcactgcggaacaggcgcaccatctcccgggtggtcaacaccatgtccacatccgggtcgccgcaggcgtccttcatggtgggcagctcgctctccgccttcttggcagagcagggcatgatggacaccacaaacagcttgtgggggtcgatgcccttcttctccgcgaagtagctcttggccacggcaccgaacatctgctgggggacttggcggtggacaggttctccgtatagtcggggaactccgtcttcaggaaccgcacccagccggggcagcaggatgtgaacatgggccagcggtacttcccacggtgggtgaagcgctcgatgaactcactgccctcctccatgatggtcaggtcggcagagaagttggtgtcgaacacatagtcgaagcccaggcgcttcagggcggccaccatacggcctgtagtcccctgccgggggctcatgccgaattcctctgcccaagccacccggaccgccggggccacctggaccacggtggtgatctccgggtccgccagggcccacagaaccttgttggtgtcatcccgggctgtcagggcgccggtgggacagtgggtgacgcactggccgcagaacacgcaggcggtgtttttcagatagcggttgtagctgacatccacggtggtgcgggagccggtgcccgccacgtcccagatgtgcatgccctggatcttgtcgcagacctggatgcagcgcatgcacttgatgcatttgctggcctcccggacgatgggaacgctcaggtccacattggagcgctctggctgcaccgcatagggctggtagtggatattcaggtcattggaaagcttctgcagctggcagttgccgctgcggacgcagaccgtgcaattggagttgtgctggctgaggatcagccgcagattggtcttccgggcctgccggacccggggagagttggtctggatcaccatgccctccgccacctcggtgttgcaggcggggaccaggcggttgacgccctcgatctccaccatacacatacggcaggcggcgatctcgttgatctccttcagaaaacacaggtgaggaatggggatgccggccttctcggcggcttccaggatggtggtgcccgccgcgacggacatctcccggtcattgatcttgaagtttaccatttctccacacgtcctcccttgaagtttccgtagccaaagtgatcgcaccgcaggcagcgggcagactcctgggcggcctcttcgtccgtcatgccgcactcaatgcactggaagtcgcacttgcgctcactggcgtcgcgctcactggaattcacgcggccatggggatggattcccttgctccaggctgcgggcaccgtgacatccaccttgatctcatggttgaagcccagatattcgtcgatgttggcagccgccgccttgccagccgcaatggcacgaataacggtggcaggaccggtgacgcagtcgccgccggcgaacacgccctccatatcggggatttgggtgctggtgttagcgtccacgttgccgccgcgctggatcttgatgccgctctcctccaggccccgggactcgatgccctggccgatggccacgatgaccgtgtcggcggggatccgcagaggctccacggaggcggtgttgggccggggacggccggccttgtccatctcgccgatgatctggggctgggtccagagggccgtcacgtggccgttctcgtccgcctcgatcttcagcggcgcctggagggtcaggacctcggcgccctcggcaatggcgccctccacttcctcctgctgagccgtcatatcctcctggcggcggcggtagacacaggtgaccttggcggcacccaggcggatggcgctgcgggtcacgtccatggccacgttgccgccgccgataactgccacgttctggccggtgaagtcaggcatctcctcgtcgccgatgcggcgcagcatctccacggcggagatgacgccctggctgtcctcgccctcaatgccggtctttttgtcggtatgggcgccgatggagatgtacaggcagtcatgctccttccggagctggtcgaaggtgacatcctggcctaccttcacgccggtcttgacttcaatgcccagggacaggatggagtcgatctccgcgtccagcttctcccgggggaagcggtagctggggatgccgtagcgcatcatgccgcccagcttggtctgctgctcgtagaccgtgaccttgtggcccatgagggccaggtagtaggcggcggagagaccgccgggaccgccgccgatgatggcaacggacttgccggtagcgggagccttcttgggctggggcacattgccggcgtggtccacagcgtagcgcttcagcccacggatgttcagggcgtcgtccaccatgttccggcggcagcgggcctcgcagggatgctcgcagatgtaggcgcaggcggtggggaagggattgtccttccggataagccgcacggcatcggcgcagcggccctcgttcaccagggagatgtaaccggggatatccacgccggcggggcacagagccacgcagggcaccgggttcttcaggctgcccaggcagcggtggtggagaatgtgctcctcatagtcatcccggaaacccttcaggcccatcagcaccagattggcggcgtcaatgccgatggcgcagtccgccgtgtccacgatgacctgggcagtggcctcgatccggtccaggatcttcagctcgggctcgccctccagcacctcccggatcatgttggaaagctgggtcagtccgatgcggcagggcacgcacttgccgcaggtctgggcctggcacaggttcaggaaattcagcgccatatccacagggcacaggcccggagggctggcggcgatccgccgttccatgttccggtacagctgctccaccacagcctgtgcctgaccaggcatcttgacttctaatctgctcataaacctttcttcatccctttctgtttccattcggcagatatatacattttcttttctttcgctttgatttcccaataaatcaggaatgtcagaatttctcacaatatggacgcatgtagtttcgtgcggctacgttccctctcagattgaatatgcagtatgggtagcaattgtaaaattgctacccatactgggagagagtatatcccattgggaggtgaaaccaacaggatatggcaacgagcgttctccttttctctacaggctatcccgtctattttgaaaagattatcttcagtgagatatgtagaaacccaaacttttacaaagccagtattacgcaaattatcgcagttttagcgaatacacctatagtttgaatatctgcaacaatcatttttttctacgcaaaaagcataacataattacgcaaaaatgtgaaattctccttttttatagaaatttcggaaaagcaattctaaatacgcatacattaatcaagtcgaaagtaattgtaaaaagggaggaattgcatgctttcttttcatgatctataatttattccacgtattttcatctccacaagttccttagctccacccgaacccgtgggtttctcggtcagggaaatgacaggaccatatgctttcatgcggtcctgtcatttctaaaaattctattacatgttgtaaataagttcaaaggcgtcatgcacagccttaaaaatatttgcaggtttcttgcaagagccgatctcatatacctcgataccagtgccaatcagagcttctttcatggacagattggaacgcataccaatggacatcacgaccgtatccgcctcaagtgttttactttccccatccgcagactgaatcactgctcccgcatcattgatctccaacagccgatttccagtatagacgggaacatggtagtgctccatcagatcttcaagcatggacttgcactggttggggacaaattccaggctcatgagattgggcatggcttccacaactgaaacctttttcccctgcaatgcaaaatgcatagcagtctcacagccaatctcaccgccgccaacaacaaccaccgtttcaccaacaggtttatgcccttccaacgcatcgatagcggaaacgctcttgggatgatcaattccgggaatgctgcgcggcataacagaagatgcaccaacagtcaagataactacatcgggatgcgcggaaataatatccctatgggtaatttccttattcaggacaatattcgcattcagttccttaagttcacgctgataccacagattcaaatctgtgacctcgccctttaagggacggttgcctgccgccagcagttcgccgccaaggtggtcagacttctcatacagtgtgactgtatgtcccgcttgaatcgccgcacgagtcgcttccatacctgccacgcctccgcctacaaccataatgttcttgggagtcgttgccttccggggcggatagaacgattctctcattgctctgggattcacagcgcatgcgggagggaggccctggtcttcaacgcggccaatacagccaaagttacagccgatgcacgggcgaatcttttcaggcatgcccaactctgtcttcttggggaattcaggatcagccaaagaagggcgggaaagaacgaaggcatccgcttgtccgtctctcagtgctttggcacaaatccagggatcacccatacgagaaccagccagaatggggatcttgacagcttctttcgccttagcatacagttccaatccatgccccttcggcatataggcggggggcatgcataataaaaggaatcgtatgtaccgacatctacactcagcgcattaactccataggactccaacatcttgcagatttcgatgccctcttccaatgtacgccccgcctcgttttctcccgtcagagaagccttgttgaacgccttaacgtagctcttcaagcccaggcgaacagaaatcggataatcatcaccacaggtttgatgaattccctcgataatttctttgacaacacgcatacggttttccaatgtgccgccatattcatccgtgcgctgattggtcatggccatgacaaactgatccagcagatagccccagtgcacagcatgcagttcaatgccgtgaacacctgactttttataaagttcagcagtcttgaccatcagttcaattttcctcttgacttcatctgttgtaagcgcggtagaagtcatagatgggatgctgtaaataggcagcggagaaggggtcttaaatcctggcgctgttcttcctacacccatcgatgcctggcaaaacagttttgtatcatacgcccccaggcgctctaccaaccgttctgcacccctgcgaaaaacagtcggattatacagtgggctcttcatgcttttggggtcaaaataatcgatctccgtatccgtgaagagaacgccagtggtaatgaggccaaagccgcctttggcccgctccaaaaaatactcttggacaacatcattccaatcttgcaaggaaccctgaataccggaaatgcccattggccccatgcagaagcgatttttgatttggaccttgccaatgttgaatggggtaaacagttggttcatgtcttcctgtgtcacttccggtgtattaggatgatgattctcgtacatacttccgcctcccagtaaaatgtcttttgtaatgatagggcatccagttgcgctgtgtttattacgtgatgggttatttcaattatatctttcgcaagaaatgttgtgaaataccggtttctgattgttttgaaggtttgtttatactttttttgcatagagatatggcatgtgccttatgactttgtggagtattaacaaggggctggttttcaaatttcctcttgccaagcatagttttttgtaataacctgaaattaacagcataaaacctgattgaattgccgcgatcattgtgtgggagggcttttatggactataaaagtattgtctgctttctgcgcgtttgtgaactgcacagctttactaaggccgcagaagacctctatatttctcaaccggcgctgagccgacgcatcctcgcgttagaagatgaactgggcgtaaaactattggatcgcgcaaacggtggcttgcagctcacagaaggcggtaaactgttttattcggatgccaaaaagctcatcaatgtagaagcagctttaaagcagaagatggaaaagcaccgtgatggcttttacggcgaggtacgtatcggatatagttcttattgttttatggaacctctcatgcatgctgcgcatatgttgggagaaacctatcccaacattgagccagacttccagtctatgtctccccgatatgcgatttacagctttttacatgggcaaatagatatcgcttacctttgccggggtgatattcctcaaacaaacgattctgttattgaggtaattgcaaaggcccagtctgtcattttaattcccaaaggccacaaactatgggacaggcaatatgtaacatgctctgatctggtgggagaacggtttgcaatatcaaaaaccaaaagccaggtttcggattccatacgtgagagctttgaagccaaaggagtattccttgaaaacgccctacaatgcgaatctgcaaacaccaggatctttcaaatcgcaactggaagatatatcggcatggacggagtatattcatctaaatatttcgattattatgcggattgcattcgtgcgatcccttgcgcggatatggattttaactttgctgattattgcgcggtgtatcatccatccaacggaaatgcggaacgctttgtgaactgtatgatagagaattctgaaaagcagaaataaataataggcattcatgctcgctgtccaacttggatggcgagcatttttttgctgtaaaagacagacaccctatgtcgaaagcgaatgataaggcacgcattttgataattagccggcatttcacataaaagaggcagtgtgatagagtgaaaatgtaagcaaattggataaaaccgcatatccagcttcaaaatgcaaggaggtaaaatgatggaagttcgcgaaaaagtgtccaatgaggatctgcaggcatatctgaaaacgctcgtagaaaagagcaaggttgcacaaaaacagttcgaacgcgattataccaagcagcggccgatcgatgaggtcgttagagcaatcggcaaagctgtgtgtgacaatggcaaaaccttaggtgaagaggcatttgccgaaaccggtatgggcaatgtggaaagcaagattgccaagctgacgaatgtggccctgctccagtgggtccagatgcgcgggaaaaattcagtggagtacgaggattgtcccggcgaacccggcgtcaagtatctgcccaagcccatgggtgtaattggtgccgtaatgcccagcacaaatccgattgctactatcatcggcaatgccatgatggctctgaagtgccgaaactctattatcattttgcctcaccccgcttctgtgaaggtctctatgaagacagtagacattatgagagcggcactggaggaaatcggtgccccagctgacctggttcagtgtatcgacggtgaatacgcaagtattgaagcgacgatgcaaactttgtccatgtgtgactgcaatgtcgcaactggcggtgccgcaatggtgaaatccgtttattctgtcggcaagcccgcttttggcgtcggccagggtaactgccaggagatcatcgaccgcggcatgacagacgaagaatatgagcgcctggttaaactggctattatgaacagaaccgtcgacaatggcgttccctgcggcggtgaacagactgctcatgttcctgaagaacttctggataagtatctcggcttcatgcagaagaacggctgcttcctggtcgacaatgacgatgatattgccaagctgcgcgatgcgattttccccggcggaggcaccagcatcaacagaaaggttgtcggtaagcagccccatgaagttggcgtaatggcgggcattgaggttccagaagacacaaaaattctgcttgtgaagaaccaggcctggggcactcgggacgttctctgccgtgagattctgttccctatcattcgctataccacttatcagaagttcgaagacgctgtcgacagagcaatcgagaatctggaagtcgagggaaaaggtcatagcagctgcatctggagccacgaccaggagcatatcgagtatactgccaaacgaattccggtgggacgcttccacatcaaccagcccactgctggctacaacaatggtgtcagcaagacgattaccattggctgcggtacctggggcggcggtttcccctctgagaatctgcagtattatcacctgatgaataagaccagagtgtctgtggaactcaagaaccccaagccctggtggaatgagggatgggacagcttcgaaccgttcgacatgggaaactgaccggagtatgactatgaaactgtatgagggactgaaggtagtcgaatttactaccaatattgccggtccgactgtgggacagtggcttgccgaatacggtgcggaggttatccacatcgaaaggcccgtcatcggtgatgacagcagagcatatccgccattggtcaacggcatcagcatcaagtattgtactctgaaccacggaaaaaagtccgttatccttgatttaaaagacccggatggaaacaaaattgcccgcgagctctgcaaggacgccgatatcgtactggaaagcacccgtcccggtgtcatggaccgattgggactggggtatgaggctatgcatgagttgaatcccagactgatttactgctccgtctcggcatgggggcagaccggcccctatgcacaccgccctggttatgacctcattgcgcagggtgcatccagtattatgtattacaacggtgacgaagaaactggccctgtaaagatttttacagaaattggcgatcagtgcggcggtttggcaggcttcgctgcagtcaatgccgcactgtactaccgcgaaagaaccggcctggggcagcatgtggatatctctctggtcagagtcctggcatctatgtctgtaaaactggacgatctgcgtatcctccacaaaaagacagagaaacagggcaatcagggttccccccttctgtgcccttacggtgtctttaaatgtccggatggcaattggatcattatagccgcgtccaataacgctttggcattccagttcttccgggtcattggccgagaggatctgatctccgacccccgctttgaaaccaacgtaaaacgtgttgaacaccagaagatcctggcacccattatgtacgaatggttcgacaaaatgggtacgatcgacaacatcgagaaggcgcttctggagggcggagttccttgttcgcgggtatacagttatgaagatgtggacaaggatccacattatcatgaggctggttggtttactgatattcctatgcccgaagaaatgaccgatctaaaggcccgtaggatcgtaagcagtccctttggtttctccgagatgtctcctgagtatattcccaccaagggttttggcgcatggaaccatgagatcatcggggaattgggatatactcccgagcagatcgacgagcttcaggagaagtggaagcaggctatggcaaaaaattgattagcagtctgtatatgagtgacatgaagaatcatcctgttacatcgctcacttatcctctaaaagcttcttcccacaggaagatagcagtgattggcggcggtatcgccggcatggaggcggcttctactgctgcggaatgcggacatacggttgaactgtttgaacggcaaagctctctgggggggaaatgatcccatctggcgcatgtgattcgaatggtgaaattcgcaaacttcaggaatggatgctgtgcagactggagaaacagggaatttccgtccatctcaatcgagagatatctgtcgaggagatccggtcttcgggatttgatactgtcattcttgcaaccggagcgggcagcacggtgtctgaccctatcaaaggtgctgataaggcaattcccgcggcgagtgccatcaaagacatttcaaacatcggcaaaaaagtgattgttgttggcggcagcatcatggggcttgaaaccgccgcgtgcctgacacaggccggtcggaaggtcacggtcctggaagcgcttcctaagatcctggactgcaattttatctcccaggcttacaaaacggtgataagcgatttcatagagcatctgaacattgagatcatcaccaacagcagggtgatcgaaattacagatgagggggtgatccttgcaccctgtgacgattccggggaaaaagattttattcgcgctgacagtgttgtgatgtcttttggttcgaagcaaagcaagcctcatgttccggttgactacggcaaggatattgcggtgtacgaagtcaattccattcagaattctgacgatttctataatccggtatgtcaggcattcgaggttgcatatcatttgggtcaggagcaatcggcgccaagtgcgcatatcaggtgaaggacatgaaagatttgagagatgaactgtttcaaaaaatagaacacaaaaaaatcacagcatgtctgtatacagacatggacggtgttgtctccggcatctccagtgctctgaacgaagcagaacgtataggcctcattgtggatttttctgtctctgagggaaccgatgtgctggctggagatctgcttatgcagatctccggcacacccaagcaaattgcagttgcagaggatatgatcatcggtcacatttctaagttttccggcgtcgcaacagcagcaaaggcttttgttcaaaaggcgggccatcatatgcggatcgtttgcggttcctggaagaaaatgtcctccaacataaaaaacgaactgcgcacggccatagaaactggtggagcgcatgtgcgtatatcagacgatccaatggtctatcttgataagaattatgtggctatgtttggcggaattcaagcaagtctcactgctgccgcacagttcaatgaccgcaaaaagtgcattcaggtcagagggcgttttgagaatggcgatattgttcgtgaagcatggacggcaattacagccggcgcggatatcgtctatgtggacaccggaagaattgatgatttgaggcgcattacccagagcctcaagcccgtccttcaggagatggaagcaaccgccgattaccggaaagtcgaattcgcttttggcggaggcgttcgctacggcgatctggatgcactgaaagaggccggcgcggatattgttggcgtcggacgaagcatcgtagatgctcccctgatggatctgcgtctggaagtaacgaaggcagaagaccctttgtacgcccacggtgactacgatttgctggataaaagcgaattaaaaatcgagggcattttcttgaaccagacaaatctgacggaactggcagttgttgttgcagaagaaatcggaatcaatgccgaagatgtattggtcattgatgttcgcgacggcacagttgcgttggatattctgcaaaagcgtctggatccatccaagtttattgccaaagaagaacggattcttcgccgcctgcgtgatttgaagggaattacgctttctgaagaggcccacatcagttccaatggcatgttgggctggatcgtcggcaatgatgcagatatcgaagaaggcctccaggcgatggaaatgtcgcagagtctggtgactcaaatcaaagaaagcatttccaaccgtgtgatcgtgttcccaaccggaactgaagtggaacgtggagagattgaagacaccaacacccctcttatcatgggaaaattcgctgcggcaggcttttcggttgacaagggtgaaattctgaaagacgatgtagagctgttttcccggaagctgtggcgtgctgcagaaaagggatacagcgtttcgatcaccactggcggtgtcggtgctgaaaacaaggaccacagtgtagaggcggttctgcggctggatccacaagcttgcacaccttacatagcgaagttccaggttggacatggccgccacagcaaagacggaattcgcatagcggtcggacagttagggttaacaaccttcattgccctacctggccccaatgacgaggtttccgtttgtattgacacggttgtacggggaatttccgaaggttggagtaaagagattcttgcaggtgaactggcgagaattctaaggacccgactgaaggaaaagattggggttatgatgcattatcatcataatgcgtaattgatattgtattgcaaatgttccaaaggaaaaaggaggaggaattaaattgacccatatctacagagtagcaaaagtggacaagtccaagtgtgtcggctgtaaacgatgcgagcggcgttgtcccacaggtgccatcaaggtaaaacctgcgggtgactgtaagtatgttgccccctgccaaaacacctgccctgctggcatcaatgttcctggctacgtagcccttgcgggaaagggtgactacgaaggtgcatatcgtctcatccgcagagacaatcctttcccttctgtttgcggcagagtctgcacgcatccttgcgagtccgcctgtaaccgcggcggttacgatgattcggtggcgatccgcgatgtgaagcgcttcgttgcggataaagcatatgacggcaagtttgtaaaggagcctgtatggcccaagaacggcaagcgtgtcgctatcatcggtgccggtcccagcggactgacctgcggttattatctggcacttaccggctatgaggttgatgtgtttgagtctgagagcactgccggcggcgtgctgctgttcggtattccggaatatcgcctgcccaaggaagttctggctcgagatatcaaggccattgaagaggccggtgtgaagattcatctgaacacgaaggttggcgaggatgtcaagtttgaggatctgacccgtgattatgacgctgtctacattgctaccggcacccagttctgcaaaaccgcaggtgtcatcggcgaggataaggctggtgtttatcacggtctggacttcctgaaagagatcagccacgggaatgcccccaaaatcggaaagaacgtggtggtcgttggcggcggcaacaccgcaatcgatgtttcccgcactgctgttcgtatgggcgccgaaaatgtgaccattgtttacagacgccgtgagggtgatatgcccgcagagcggcgcgaggtcattgaagctttggaagaaggcgttcagctgcagacgctggtgtctcctgtcgaaatcgttggcgacggcaaggtcgaaaagatcaagtgttcccgtatgaagatcggtgagcccgacgagcgcggccgcctcagcacccacgcaatcgagggatccgaatttgaactggaagcagacactgttatcatggcagtcagtcagtacgccgatttccccttcatcgataaggacgaagttgagctcacagagtttggcaagctggttctggatgaggagcgcatgaccaccctgcccggcgtatttgccggcggtgatgtgagccgtggttccgccactgctattgaagccattgcagacggtaagcaggctgcaattaacatcaataactatcttaaggctcccaccggcatcaatcagggtgcggagatcgaactgcctcccagagaggaatttggctggagcaatgcgctggtcagcagaatgcacaatctgccccgggaagagcgcattaagaataacaaagaggtcgctttgggccttactgaggagcaggtcaagacagagagccagcgctgctaccgctgcgtgggtaaggcaaccgtagacgaaagcatctgctatgactgcggtatgtgctgggagtattgcgaccagggtgccattaccatggagcctctgcctgagggcagaacgttgcagtatcctctgcctgataccatggagcgtgctgaagaaattctcgctatctgccgaaaggcacacttgctgcccatgcagatcatctgcaagtgcggccctaccaacacggaggaaatcgtcaacgctattctggatggcgcacgcgacatgacagatctgacactcaagagcggtaccagagctggttgcacgatgtattgcgttggccagatcagccgactttttgaggcatgcggacgtcctctggaatcccgcgaagatgataactaccatcctatcacccagactctgtgggacttctccgatgaagcactggactttgacccgatcttcaaaatgagagaaatgcagaccactctgtacagcgacgaagtgtttaatgcggctgcagatgcctacagaaaagtggtaaaggaaaggagcgagaagaaaaatggctaatgcaaaaatgtaccctgccagagtaacgcccaagtgtatgccttccgtgtatggcaatacccctgctatgcgtggatatgaactgccgggcatggtctctgtcaatgtgcgcgacttatttcccaacatgcctgaggccatttacgaaggtgatgacagcgatcccaaactggttgaactggctacccgtaaggctcttgaaaatgtcgacatgtccaaaatccatcatgatgacaccgtcaacctgattggctgcgagcacggtttctacatctttggcggcagaccctatatccagatgctgaaaaccatcaagaaggtcgtggaagagcggaccggcaactacaatgttcgcctcagatgcgtgatgtaccgcacccccatggaaggcaaagaagttgtcgaatactacaatctgatggaggaatttgagggcaacgtcgagtatgtagctgcatatgacaaggcagtccccatcaagaccagagttggtacggtttacggcctggagaagtgctacgatgccgacaagatgatttttgcggcctacgacgacccccgcgaggtctactgcagtatgtattaccgccgcgtattcaaggcatttaccatggatatggcccgctttgagacccgcaacttgtatcatcatgctttcggtaccgctatcggccatggtcctatttccaatattgtccccaccgcgatctatgactctgactacgttcagagcaagtgggtgtttggcactattttgcggacaacgcccgctggtgtttccggcattgatgcagataataacctgtatgccatcgatgaccgcatgatgatcgaaaatctgaaatggtatccttacatgcatcagctgctgatctccctcaaggattactccattgtttgcgacggctcccggtggccctactataccgctgctgccggtatcatcgccggtgtcaatactgctggctggcaggaccactacgatattgataagcgattcagcgcgctggatctcagagcgctgcccaccaatgaaggcttgaaggccattgtgtataaccagacctgggttggtatcaatgttacctggccgatgacccttcctaccatttttgtgggcaaggatcagctggacatgtggattgaggaccccaacaacagaggtatcgaaaactggaagtataccatgctggaagacaccttgcctgatgcaatcaagaaggcagcagagattgccggctccgataaggtcgtcctctacgatggcagcttcggcttcctgaattgctctcgttctgcagcagaggaactcttcgaaaacgcccccaagatccgcaagtgggtggatgaagagctgtatcccaagtacatgaaacagcgtggtcttgagattcccgattatatgaagtgattcttgcaagtttcaagcaaccagcaggcactctactatggagagtgcctgctgggaaaagtaaatgaaccaaagagaattcacgttcataaataaaggagcttcgtgtatgacttgttttgaaagagcccccgctaataagaagcgcctgaccctgattgctgtcttcgtaatgctgtttgcttctgtgctccagtccggtactgactctgtgattctggcgctggcagccgcagagatcggtggcaccgaatactatgctttggcaaaatccttttcatccgtgtctgcggctgtcctgatgcctatgtttgcctatttgggcgcaaaggatccttctcgcaagagaagcctgtttatttggtctgctttagccggtgcggtttgcatcttccttcgtgcaattgcgacgcatatggcaattattgtggcagctggcattctgcacggtatgttttcttccggtctctatgtcattggctattctatcatccgagatatttatgaccaaaagactgcagcaaagtatctgggctttgtcgttaccatgaacagcctgggcactttgatcggccctattgtttccggtgttatgattgatatgctgggttggagaattgtttgccatatcatctggatcattgctctggtcagcgcattgctcggcatggccggcgtgaaggtcaccaaggaagatgctgcggaattggctgttgaaacgggttcctttgatcttagcggtacgatttctctgagcgttttcctgggtgcgatcagcctcttcctggcactgggctcctctctgattccctttggcagcaccaccagcaatatccttttggttgtaagcctggttggtctggttgggctgattctcaccattcgtaagaagggtaacaattgcatcatccctgtgccggtgttgaaggatcggaataccctgattctgacgatcaatagtttcttgatgaatttctctctgattgccattttcttctttattccttcttacatcctttatgtgctgaatggttccgctacgcagtccggcctgaccactacactgctctctattcccggcctgttcatggggcccatttactccagaatgattgccaataagggcagtgcaaggggtgttctgacaattggcatgattcttcgcgttgtggttcatgccgcattcatcttcatcctcagtcccagtaccgacctgatggtgatctatgcgctgatgattatcgccgggttctaccagagcgcccatgtttgtacgatgaccactgcgccgcagatccagcttgcagcggacaagcgcacttatggcaatgcgatgatccaagtaaccatggcactgggttcctccatcggctctgcagtttactccatggtgattgctgccaagggtattgtggatggcttgaaggttgcctttgtgattgccatggtcgctgcgatcatcgtgctggtcatttctcagttcctggtcaagaatgaggaaaactgattaaagacacttaagctggtggcatatcatcccggttgagagacaagtgtatacttggttcccatctgtttgatggcacggtatgccacgcaggcacaaaggctctgtttcatatgtgcagggcctttgtgtcgtattccccaatcctcagctgaacgaaacaatatttgtattaaaggagaattgaatatgagtatttggaatttaaatgtgaactgtggaattacatttggagaagactctcgcttgacagttggggaaaagttgaaaagctacggagccaccaccgcgctgcttctctacgatatggccatggatcagtttggctatcaaagagagatcgaaaaagttatcaatgacgctaatatcaaagtagtttgttatcaggttgaggaaggtgaacccaccgcccagaagtctgaccgggcttatgatttcgcaaaggacaagtctgttgatgcaatcgtcgccatcggcgggggcagcaccatggacaccggcaaaatggtgggaaaactcttggcgaacggcggtaagacgcgggattatcagaataatccatgcattggaaacactgtatttcgtccgctcattgcacttccgtccactgccggtaccggagctgagttgacgccctacctgacctgtgcaacagaagacgggaaaaaaggcggtgttgccaatacgcctgttacctgtgcgatcgtcgaccctgtgttgacttataagctaccccccgtcgttacggccaacaccggtattgatgcactgtgccacgcttcagaggtgctgtgcaactgtaccagtataccgaatccttttgcagaccttgtttgtatggaggtcatccgcaccatattcaaatggttgccaattgcctatcaggacggctccaataaggaagcccgtaagtggatgtcctatgcggcaacgatgggtggtttcgcactttgcctgcgcatgatctcgtttggccacccaatcgctaaccagatttccaacacgttccatacccctcatggcgctggatgcagcattggcatgactgctttcgtacactacaatgttactgagaatcccgaatggatccggctgaacgcagagtgtcttggcatccagcaggatggcctttcctatgatgaagttgccgttcaggtcgtgaaggcttacgacgatctgcgcaaactgtgcggcatgaagaacatcaaggaattaggtgcagaagagtcctacgttgatgaaatcatcgaaaacctgaaagctgacaaaaacctggcttataatccctgtccgccgaagatggatgttttgcagaaagttcttcatgaaatctacgcattataaaatgaatgctgacaggtaaaagcacaataaaagcagaacactggaagctcttttcttagaaacattttttaatcagggtggagtgtatggaaaacaaacagcaagaacacacttatgaatcctccaatgtaatgccgtctcttggtgaacggatcagttatggtgttgcagattttggatatgcttccgcttatatgtgggtcagctcgttcatgaccatcttttttaccgattatgtcggtgttccagctgcgtctgtttcggcattgctgttggtggtgcgcatttttgatgcaattaatgatccaatcattggttccattgcagatcgtactaagtcgaaatacggacgttatagaccatgggttgccgttggcggaacagtcatgtgtcttatgattgcactgatgtttgccgtgcagccgacctggtctatgggtgttaaaattgcctggatgtggatcgtttacattgtggtcactgtagcagctacctgctatgctatgccttttaatgcccttggtggcgttattacatcaaatgacgaagggcgcgttaaactgtcaaatacccgaatggtgtgttctagcctaggttcaaactttaccaacctgattgctgcaacgctaattcttctgttatctggtacaaaccggaccagcaataccgctcagggttattttggagctgcggtatgcagtgttgtgatcagtcttccgtttatcctctggagtgcggtcaagtccaaggaacgcgtgcaaccgccacctcagcaaatggaaaagaaaagcaaaatttctctaggacttcagatgaagtgcttgttggggaataaatatgcactggggtgtatgttcggtcagtttgtagccggtttttatacctacggccgatacacaattatggcttactacttcacctattatgaaggtgattttaacctgtattccataaccggcatcatcggcttgtttaccggcattgctggttctggactactcggcccttggctgtacaaagtcattcagcataagggcagagctgtgggtaccgcatttggcctctccggtattctctccatccctatgttctggctttctgcaaaaggtgtcctgttctgggtcttctacgctgtttccacagcacttggtactgcggcatttggcctgcggtatggctgtgacggcgataacgctgactatgccgagtataagtacggtatccgtgtggatgggtttctttccgcctttatctctatgatgctgaaggctggcggtgccgtaggtcctgctgtgttgctggtttggctggattccctgggctatgtagctaatcaggctcagaatgccagtgtactcaatgcgctgaatatgggtatttctttcatccctgcagtcttgcttctccttgttgcattaaactttctgattttttatgatatggacagcaaaaagcatgcggaaattgtgaaagaattggaatgtcggcgaggaactgaaagcaaataacatataaaagcattttgtttcaccagattttcatgagaaaagattgcaaattcgaatactatacaaattaaatggatcgaggtaaatcagatgaacaaacagtttgaaggtaaggttgcatttatttctggcggaaccagcggcctcggtaaggctaccgtatatgaattggtcaagcgtggcgcacgggtcatttttgtcggcagagatgatgccaaggctcaggaagttatcaacaaatgcaaagaactgggcggcgaggctgaatataagaactgcgatattacaaagcatcaaaatgtgattgatgttttcgggtatattcgagaaagatacggaaagcttgactttgcaggcaatgttgccggtacggggattccctccacccaaattgacgataccacagacgatcagattgatatgatgatcgatatcaatttgaagggcctgatttactgcatgattgaagaaatcaagattatgcgggagcatagcttcggtcgcatcgtcaatattgcttccggtgcagcaaatattggcgctcccggcatggctgttttggcagcatccaaggcaggcgttgttggtgtaacaaaaaatgcatgctttgacgtggtcagggacggcatcactgtgaacagtatttctcctggtgccattgaaacggagttggttcagtccatcaaatatacgcatgcagaggagtataagtcatatagtaataacatgcctatcggcagatttggtatgccggaggaaattgcacatggtgtgtgcttcttctttgaggatgaatctgcctttattactggtgtgaatctgcccattgacggcggcttctgcgctggaaaaatggtgcgctaattctctgcctgtataatctcgcaactttgcaatattcccaaaagggcacgttgcaaaatagtgcctaacattgcggataggaacccgaaagggcttcctaatcgagataagggcggttagccccgtcctctcacaccgctgtacgaagggctccctatacggcagttcaatcgtatagtgcagagactcgtacctgctggatagattatagcatccggttcgtgcaagtctctcgtttgtaatagaacttgttaatgtatcctgaataatagaaaaagcgtaagtacactcaataatcacctgcaccggcgaagtatcttacaccactcatggttggagcgtttttgttttccgtagttcttgggatcgcctttgaaatgtacccggctgcaaaagtatccggaatgatgccgatggcagcactcgggtcggaatagaggcttgaaatttttggatgacatataaagtgttgtgctatgtctctaatcagatattgagcccacttctctttgataacagcgtatcaaaatgtggaattcacaaaagtaaaatacgcaagcggtgaaatctggagaagcgacacaaactaaagttcgtttagaaacgcaagagagattcttgcgtttcttggacaacataagagaatttaaaagaaagttaagaaatgccttgcgattcttctttactttttgcttggcttgtgttatcttggcccgttagtggagagtgtcgccatttggttgactatgctggataagccacacagtcctaaatagcggtttgtgacggtgtgacttaactattactgctttttattaggatgtagagatgaatgaccacacaaacagccacagacctgcgtggaatatgtggaaacggtggacttaaaaggtgctggaaatcaaatgaaacggaacggaaatgaccataaacgaacgaaaaatattataaaaagtttcaaatgtcggttgacgtgcagggggtcacaggttcgagtcctgtatcgtccaccatcgaaagttccgctttctgttgaaagcggaacttttttataattttttcacaattttcatgcgtgttatgtaaccttattttatccctgaccactcaaccagccacagtcaggaaaaatacgggcctccgagagcagttcgccctgggaggcccgtttgttcaacctgccagttctgcctgcttccgccgctttttctcggcggcgatctccgcgatcagccgggccaacttctccttgcacaccgcctctgtatggacggagacgttggtgccattcgtttcccgttcactttcggggagtagagaggctgggacgctccagttcccagaagaaccgctggtgcagggccttcatgtagtcgttcatacgtgtcgcctcccttgttcagcaacacaacatatcacagaaacagagaatagccagggctccggcgcaccggcccgcggactccgctttcttccaggagactaatagcggaacccgtaatcgtcttatttctcagacgcctgcactcggctctccgctcccccactcacctccagaaatgcgcagagggactgcttgcttatcgtgtaatacttgggcgggtccaagaacagaaacagaatccggatggcagtctcctcgccggtgtcggcatccatggccgcaggaatcccatcgatagttttccatcgcaccgctggtagtacccggtatagtcccgcccgcccagcataccctctcccattccatgttctgctttcagtatagtggggtaaggagcatctgcaaagcattcacatctcatcatctgattttatgggtaagtgtgagcagaggggcgaccgtttggctgcccctctgtttcacgtttacattactgcacttctgatgaatatttatagtgccccacagagcaacttgcagtcctgagaaagaaaacttatggtgtcaggaaactggctcccgtgtatagccagttgacgcatacagacgtacgggcaccgcctcgggaagaaaagattcggatctcacacatggaccaaagaccggtagagggctcttgttgccggattcgtgtccagtgcatctcctgagactggctgtagatcagatcatccactacgaacacacctgagattgtcaggttgtcattggtctggctgtcaatagaagctccatcgtaaatacttgcgcggcgaatatcggccacaatagacgttcctgttaccgcaggctggagggaaaagcggagtgaagtggccgaagtgttctgcaaggtcatgttcagcgcctccagaggaaccgtcaagacacttccagcagaggacagatttgcgttgtaaacctccggaacagcttttagattgggagtcaggaaatctgtctccgcagttttaaaccgaaccttgtagacagtaggtatattttgctccactgtaatttcaggagtctacccagggatgccctgcggtccttcgggtccaacttcaccaggttcacctttcggcccctcggggccaacgggaaccacaaagtccagggagatcccggtgtctgtcggattggcggtgacggctgcggcagtaccagaggagacagttcccacagtgacggtaggtgtcgtgcccgcgggtccctgagggccaagttcaccctgaggcccggtttcgccccgctcgccctgaggcccttccgggccctggggacctgtcgggccggattctccctgagggcctgcaggaccgacgggaaccacgaagtccagggagatcccggtgtccgtcggattggcggtgacggctgcggtagtaccggaggagacagttcctacagtgacggtaggcgttgtgcccgcgggtccctgagggccaagttcaccctgaggcccttccgggccctgaggacctgtcgggccggattctccctgagggcctgcaggaccgacgggaaccacgaagtccagggagatcccggtgtccgtcggattggcggtgacggctgcggtagtaccggaggagacagttcctacagtgacggtaggcgttgtgcccgcgggtccctgagggccaagttcaccctgagggccggtttcaccccgctcaccctggggtcctgccggaccttggggacctgtcaggccggattctccctgagggcctgcagggccgacgggaaccacgaagtccagggagatcccggtgtccgtcggattggcggtgacggctgcggcagtaccggaggagacagttcccacagtgacggtaggtgtcgtgcccgcaggtccctgagggccggtttcgccccgctcgccctgaggcccttccgggccctggggacctgtcgggccggattctccctgagggcctgcagggccgacgggaaccacgaagtccagggagatcccggtgtccgtcggattggcggtgacggttgcggcagtaccggaggagacagttcccacagtgacggtaggtgtcgtgcccgcgggtccctgagggccaggttcaccctgagggccggtttcaccccgctcaccctggggtcctgccggaccttgagggccgctttcgccacgctcgccttggggccctgccggaccgatggggccctgttctccctgtggtccgggacagccgcgatctccttggagtccttgagggccggtctcaccaggaagcccttgctcaccctgaggtccctgttctccttgagggccgcggtcgcccggaatgcctctttccccctggggccgactgggccagccggtcccggatcacccttaggccctacggggccgcggtcgcctttggggcccatggggccgggatccccgcggacaccctgcggtccgatatctcctgtgtctccttttggccccatatcgccccgaataccctgaggccccgggagtccctgagggcccaccattccttttgggcccatgggaccgggacagccctgctcaccctttggcccctggggaccacgctctccgcgggggccgcgttcaccctggggcccgcgttcgccctgcggcccacgttcaccttgggggccgcgttcaccggagagaatggggcaaaaacactgacaggaggagtctctgtcaggtgcagagccgcaatgacgttctttatttaaattgttgttgggaaaataattcatctcattgacctctcatccaaagtaagggaactgtggttatagctaaagttgcttcttgtctgtgtccttctcgatcttttcattcaggcgctgactctgtgtgccgaaatagaatgcgatgacaactgaaaaaattgttaaaaaatcttggttggaaattcgatccaaaacagcgagataggcaaatactaccgtcaagacaagcgttacaatgcttttaacacacagaaggttgctgaatttcttcaagagagcagacattacaatcgttcctttctcataaggcctatgctcatggtatgctatgcacatggtggggctgaagtgtgtggttttgcttcagggaaattcgtctgcatatagtcgtccatcactctaaacggcatttccatggcaatctaactgctggaaaattcggcatttcggggcaaagagagacatctgcctgtccagggctgaaaaacgagcccgcttttcagcaggctcgcttaatggaaccattctcccttcaatgttctgtgagtatccggtgcactctccggcagaagtttctccgcctcctctttgtcctccagttcggctggtattcatacagcacgacagggtgttccacatccctgcggtccggtacagccgcatatagcatttgctccggatagtccggccctccagcttcaaaacttgcggagctgccagggattcgggcagtcttcttttcagctttcaagatgggcatttccgtttctgccgtgtgcaattttgacaagcgtatgtatgcccgaatcctcacctgtgtggggatcatgactcatgtccgccggacttttctgccaatcccctccatgggcgatccggagcatacacgcccagattcagaaagccggtgctccatcatctcaatagtgacattttcgggcggaagctcctccacttgtagggaccgctcctgccggatatggggctctgccgcggttccccttatagcagctctgacagacaaccatgcctccgtctcatcaagcatcgggctcagttgacccgccaattcctctttcatctgttcagagaatgcccacaggctttcttttggcaagacgcacctgttccatcagccattccggcttccggtttcgttccgtataccccgcgctctttcgaagcagttcatcctattccgcacgggagagcgttaccatctccgtgctgttcatctgtgtattggtcttgtttttgcaaatttggtggctaaaaattacctggaaagttgtcattttcaatgcttttgacaattaaggatactgctggtaacttaacctccgagcctctgcgctgttccgaggccactggaagcttccagcctccaaccgcttcgtgaccagtacaaatccatcctcttcccaataaagcctcttgttccagtcctgcctataaccacagaacaaaaacagcgtaccgctgaacggagctaaacggaacttctgctgtaccaatgtcgcaaagccgcatacccacaggcaatataaatctgccctgctcccgcaaggtcattcagcatccctcagcccccagcacaacgctgcctcggccgcgctgtctgctcggatgtaaatccccacttcaactgctccggttttaatcccggcaatcaccttgcctcggctcccacgcaattccgaggcggtaatttccgcgaataccggcgctgcttccggcatccgcccctctttctgcctgttttggttttcgctgtttatgccgtacagctcccgctctcaccgctggtatatctttgggccgacaccgtgttccaagcaccattcacttactcgtctccccctgtttcggcaaccttctatctgcttcttccacgtttcaagccgcgcctcatgtcaggctgctctcattgccatttgattcacctacttctgtttatccgtccttctttattatattgcgcctgggcaatccgcttttctatttggcacttgtttttatggcgcttagaagccgtagcgatatccacttttctatcgtaatacagaaagcccgggcggaaaaaatctgcccgggctttctgtcaaattgatttttgagttccttactcgtaccggctccagtcgggagcacggttcaggtcggtccagctctcatagacccggtccttggtgacaaagtcgtgggagttggtggcctcctggatggctaggtagaaccagtcgctctcgtggcagtcggtccaggtgttcatgccggagagcagatcgtccgtgtcctccggcaggcggcacagcacccggttgatcatggtcaccgcctgggcgcgggagatgtactggtcgggccggaaggagtcgtcgctgtatccctggatccagcccagcgccgcggcgcggctgatctcgtcctccgcccagtggtcggcggtgtccgtaaaggtggtgacgccggcgacgccgctgtcgtcgaaccgggcgcagatggccgcgaattcggcgcgggtgatgttagcgtcggggtcgaacaggccggagttgcggccgttgatgacgcccagccgggccatggtggagatggccgtgttggcccagtagtcctcgttcacatccgggaaggcgttggacgtggtgagattgtcgtcccgcacattctcgtccagcaggcggaagaagatggtggccacctgggcccgggtgatattggcgttgggccgcacagagccgtcagaatagccctggatgtaggcgtagtggtcgtcgccgttcagcatgccgggcacggaggtctccgtccagccggcgaacagcgtcacggaggaggtcacccgcagagtctcatcctcgtccacccgtatggtcaggcggctgtccttgtaccaaccggtaaaacggtagccgggccgggtggggatgtgggcgccgtactcctcatcatcgtacacattgagggagaagctccttccgtcttcatcgatggggtcgaagcgggtgccgccattggagtcgaacctcagatagggatcgctgtcatggccgccaccgtctccggagctatcgcgggcaaaggttgcagaaatggtgtggtttgcattaacatccgtaaatgtatagctatcgactgctcctacgctcttttcatccactttcacattggcgatggtatagccgccgttcggcgtgatggtgaaaatcttgtccgcaccctcggccacagcaacgctgccgcgggggctgatggagccgccgtcaccggcggaggcggtgatagtgaaggtctgcgcgttctcctgccagacaacagcgaaaggagagaatccggaacggtccacatcaaattcgataccattggcgtcaaattcagcggttataacctccggctcacaggcttcaatggcatccgtcacctcggcctgaccggcaatgccatattcccggtgcaggcccggaaagtggatgacctgtacatccaggtcatttgcgttatccattgtcacaccgtcgggatatggcaaatagattgtggtgccatagctggcagaaacccaggcgttgccgttgtaggcgtccaccagatccaggtagtgaaagtcgtagcggtaggttttgccatcggacaactcattcagaagatcagaatcctctgccttttgttccagcagagcctggcggtccgtgccgtcatcatcaatcagcagcgagtcatccaggagttggataccggcgatatcctcgatctcaaagtcttcgttatcgttggtgtagaaagacggctgatacacggttccccatgagctggtttgtgtctttgcaatcgcctcggcgtggatcacagccttggtgggctctgcggtcaacaacacatatgtattggcgccgtcctgcgcttcctcaatatcctgcgtatggcggacgattagtgtacccgcaccgtcaaggtttacattgttgccattcacccgaacgtcctcattggtaagtccgttcttccatttgagggtaactgtgtacacgcccggcttggaatcatctgtggcgacagtgccgtcctcataggtatagaccgcctcaatgttttcaaggagctgatcgagcatggtcttgtcgtccgttgccgggatagtcacacccttgatttccaaacttgtaatgtcgccggtgtattttacgtcaacactgccattgatggtgagcttggggaaaccgccgtcgtcatagttctcctcgccctgaccgccgccggtgtagatggtgatgtcatcgggggccagggtatactccttgttgttgaagagcatcaccgcatacggagcacctgccgtcagatccttcaaagcgatgggcaccttctccgcattctccacctcttcgaccgccacttcagccccatcaatgggtgaaccgtccggattgacctgtacataggccacatagaggtcggtcttcttaggggaggaagtaggatcgagctcgaagctgtactcagtcgcagacggctgaacccacagggcgctgctgcccacgggggtccagtcggcgtgctcgttagcaacgccagctttcagcgtgttgactgcctcattcgtggcgcggcccaggttcacatccgcatagccctcaggaagttccaccttcccggcgctgacgtatatggtacggggttcccccatcacatcagcgcttacatgggtgtactcatatccggcgccttcctccgtttcagcaacagcataaccgccggaggaggagatttgtctgccactcgatcccttattgccggaaatggtgccgccattgatctcgacgagggacttccctgcaacggtatggtagataccatagctgccgttgtcgcagattttgccgccgttcataatgaacctgacacccgtccagtcggtcttgccgctgatctggataccgtagctcgagttgcgggcaatctcaccgccgttcatggtgagattggagctgttgttcacacgaacggcaagacccttgttgtccacaatatgggcagtctcctcaatcgtggcgatgacaccgccgccaccctggttggcaagataaatcatgcctttagaggcggtattgtcgcggatggtgcccgcaaatgtgtagtgggagccgttattggaatagatcaggccgcccgcactgctggaactacagttttcaatcacgctgttcgggccaaatgtgatctggccgtaccaggaccgcaaaagactcgccgaacccgaagcgcattctgagatcgtaccgttgaggtacacctcatggctgtagttgttgttgtcgaggtcgtcaaaatagagcagctggaaaccgtccacatgagaaatcttagatcccgctttagtggtaaagttgcaaaattgggtccagatggcgcagttattgcctgcgttggtgccggtcacattggtgatctctccagtgctggcaagggtagcttcaccgtgagaccgcagatggacagcaacaccgttctgcccctgccaggccgcatcggtaccatgaatattttgaatggtgccgccgatgttagcggtgccgccgtctgcatagagtgcacgcccattcatcatgacacctttatcgccgcctatcgtgccgccgttcatggtcaagatgccgccctggagccagaccgcaccagcggggccaaagctgccggacgcacctttctcacgttcgttttcggttgtatccaaaatggcgctgccttcttccatgatcagctcgccaccggacaggcgcacggcactcataccgccgtagttgcgaagttccgcaccatcccccaaagtaatcgtacccataccgttgtaagttgcgattatggcgtcttgcacaatgcttgtatttgggacctcactcctgctaacggtggtctccccatcgccttcggaatcggcctgcacaaagtattcaccttcgtatttgcccatatcatccaaaatgatgtgggtcaaaataagagacgaaacggtcccttgttccgtttccccgcctacttcgatcatcgcggggttgtagtgctgtctggcgggatctgcgttggtatgaaaattttctccgcgggagagcgtcacaggatcaacaccatagctggtgatggtcagctctttctcccagacccatgccatttggttcatttccacatctgacatgacataaatcgtcgcaccatccggggctgcttccgccgcctttgccaaggtggcatatggagcgtctgctgtgccagtgccgtccgcatcatcgcctgctgccgacacatacaccgcgttctcagccacaggctcttctaccactgtccccggatcctcagcaggctctatgggatccagctctcccgcaggctccgtgggggccgtgggatccggaccctgagggggatctcccggaacctctgtcggctcattttcctctggatcccctgaagtccccggctcatttggcgcactggggccatccggttcatcggcggtcccactttccacggcctcctgtttcccgccttcctctgcggggtctttccgcaagtccgatccatcctgattgatcgcaggatccgactcgccagtcccctcctctgccgccagtgtcgaaaccggcagcagtgtcagcagcaggcacagcaccatcaaagctgataagatccgtttcttcatctcttctcctcctttacacctctcggcgagaaaatatctatcgcaaacatccttttggatggaattgctctcattctccgtccatccggcagccaactgctccgtatccagaatctgctcataggcttgctccgccgggagccgcacgttccgctcgatctccgaccgggtggccagatacaacttccgcaggcaccaggggttgcacttggcctcctccacccgcttgtcagacggcaggtagtgatagaaggcccgcagcttggcaccgtacatctgcaccgtgttccggctcctcccccggcgggagagtgtctccagataggaccggatcatctctgatgtgatgacagcgccagtctgctccccagtctctggcagcctggctgcctccgcgcactgcatattcacaccccctgtcaacggaattcgcattccatcccgcgcccgaccaagctggcgcaagaagctccgcagaacaagtgcgaaaaaagcccgtgcggctggcacgggcgtaaaaaatggcgcagggaccaaggccggacaaaatttgacatttttccggcttttttctgctgcccaaagcggcaaaatcccttgcggttagctgtcctttgtgctaaaatttgtctattgatatgtaggacgaactattttttcacgatcatttgtgtcggaatgcgaattccgtgattaggagatcagtcccagccggtccagcgtccgctggtgttctgcgccagaggtcaccaggtagatgcgggtggtctcgatgctgctgtggcccagcaggtccgccagcttgacgatgtcccggctggtccggtagaacaccatagcaaacaggtgccgcagattgtgggggaacaccttgcgcgggtccaccccggcgcgcccgcacagccgcttcatctccgcccagatctgccggcggcccagctcttttccgcttttggtgcgaaagattgcaccggaggcggttttttgtttttgggcgtattggagcagcttccggcagagcttttccggcaataggatggtgcggatcttgcccttgagggagatctcggccttgccctgccgggcggcctccaccgtgagataccgcacctcgctgacccggatgcccgtggcccccatggcttccaccagcaggcccagccgctcctgtcccagccggtgcgccgtgtccagcaggcgctggtactccgccttcgtcagttcccggccggcgtcccggaacagtcgccgctggaccctcaggaatttcacccggcagccgccgaggcccaggaactccagcaggctgttcagtgcggagagcttggcgttgatgctggcgggggcgtagccccgctccaccagatgagccttccacgccgcgctcaaccctttgctgatctcccgcccgtccagccagcgtgcgaaggcccggatgtcccggagatacttctccatagtggcttcgctcttctcctccagccggaggtggcgggcaaatgcctggatttgcaggggagtcagtctgtcttcggtcataagatgcctccttttgtgatttcacaacgatattttaccggatgtgcaaatataacaaggcccacagcggcagctgccgctgtgggccttgttattttagtgccgtaatcgtaagattttctccagttccaaaaagctatacgcggatctgccagtttttctatgaagggacgcgcctcctcccgttttacggcgaacatgataccagaggccgtaccggaagtcggtatgtagaaaaacgtatatgcaagttcttgattccgcaaaggttctatctttcaataccatctcaaacggctcagatagtgcatgtctgtattccttccggaacagcggcatggaattccataccgctgtcgttctaaaaatacttctctttttctgtcagggtctcatttccgatgatattctctaaactgtcccatttttagctgatagcttcgattcccgcccctggtcacgatggccccctgaaatcagatcattcagataatctcttgtacagggcggcttcaggccaatagactctgcagtttccgatgctttgcttcggaatgatcggccaggtatgtcatgatggtctcttccacccttactcttatcgctgtttttcttaaggaagagctccagcagagtccactccggctcaaaccgctctgtgattacaggcgccatacgtaaaagatattgcgatgccactgccggcatgttcgccgacatcaatgaggctgcatattttcagtatcgtcccattgcgggaatcgaagacgccaccgctctttgcctcattgatttccatgcgaacactactggggttcgccatggtgatggcgtcccattctttgatgaccactccgagtcccggcagctcgcttcgggagcccttgattcccctgagaaacatactgtcaaggcccggcggatgttgcgccgcaaaggcaatggcaatatcataccgcagaaatttgaatcgtttttcccggttctattgcagaaaatcgccgcaccggacagcgacaaagccggaaaagcccccgaaaacgcggaatgctttttccttttgagtggagcgattgtttcttgacggtttcttttgtgaaaggctttcaattttcacagcttctttccaagaattcggatatcttttccactttttatagaattcgttgaaaatactttacaggatacacgcttttttgatatgataaaaaagtaacaaatcagaagtactatgctcatttctgggagctcatctctacgccgcatcaatcccaggatcggaggaaaatcggatgaaaaaatttttaacagcgattttagtcgcagcagctcttttcacaactgtcggctgcagcggccggcccgccacgacagcggatgttctccagagttccgcggatgcggaggaaggttcgtcccatgacagccagggcagcctccgcaccggcctctatgcggtgggctccctatcctccagcgccagtgcgggagaggaggacggtctgatccaaacggatgtgacgatcgtcgccgtcaccgtggatgagacgggcgtcatcactgactgcgtgatcgacgccgtacaggcaaaggcaaattttgacagccagggccagctcctcacggatctcaccgtcccggtgcccagcaaaaatgaactgggcgctgattacggcatgggcagcatcagcggcatcggaaaagagtggaacgagcaggcccaggctctggcggactatgtagtgggcaagacggccgatgaggtgctgggcattgccgtggatgaggccaccaagcccgcagaggcggacctggcctccagcgtcaccatctccatcggcggcttccagaacgccatcgcggaggcggtggaccgcgcccagccgctgggcgctcaggccggagatgagctgcggctggtgaccagcaattccatggccgccggcaatgcaccagagggcgccgccggcatggtggagaccaatgtgaacatcgccgccgtgaccatgaacggagatgccatcacctcctgcgtgatcgacgccgtgcaggcccaggtcagctttgacggccagggacagctcctcacggatctctccgccccggtgcccagcaagaatgaccggggagcggactacggcatgggcgccgtcagcagcatcggcaaggagtggaatgaacaggcggcggcctttgccgcctatgtcaccggcaagaccctggacgaggtggcgggcatcgcggtggatgaggccaccaagcccgcagaggcggacctggcctccagcgtcaccatctccatcggcggcttccaggccctgctggaaaaactccggtgaggctccggctgctgtccctgctgctcccctgcctccttctgaccgcctgcgccgctccggaggaggtggagacgaggcccaagcaatatcaggcgacctttctggacgtgttcgatacagtgaccacggtcatgggctatgcggagagccaggaggtctttacagagacggcggagatggctcacgatctgctgctggaataccaccagctctacgacatttacaacgactatgaggggatccacaacctcaagaccgtcaatgaccaggcggggatcgccccggtgacggtggatgcgcggatcctggatctgctgctcctgtgccgggacctgtatgcggacagcggcggcaaggtgaatgccgccatggggagcgtccttctgctgtggcacgaggcccgtgaggcgtccgtcaacgacccggagcatgcctatctcccagaggaggatgctatccaggccgcgttggagcatacctcctttgacaatgtcgtgctggatgaagcggcctccacggtgtatctgacggacccggcacagcgcctggacgtgggggctgtcgccaaggggtacgccgccggtgccgtggccgccgcactgccgacgggcatggtactgagtttgggcggcaacgtctgcgttacgggccccaaacccgacggcagcccctgggtgatcggcgtccagaaccctgatggggacgacacggagtatgtccagcgcctggatatcaccagcggcgcggtggtcaccagcggggactatcaacggtattacacggtggacggcgtcgcctaccaccatatcatagacccggataccggctggcccgcccggcattaccggtccgtgacggtcatctgcgcggactcggggctggcagacgccctctccacggcggcattcatcatggatgaggagagcggccggatcctgctggagacgtatggcgcagaggcgttgtgggtctacgcagacggctccgcctcctggacggggggctgtgacgcctattttcattcataaacggaacatgaggagaggtgagatcatatgctgcgaaagcaaaccttctggggtggcgtccaccccgcggggcgcaaggagctgtccagcggagcaccgctggaggactgcccgccgccgcgggaggtggtcattccgctgctccagcatatcggaaagccctgcacgcccctggtaaaggccggggaccatgtggacatggggcagaagatcggtgacggcgagggactgtgcgtccctgttcacgcctcggtgtcaggcaccgtgaaggccgtggagccccggagccaccccagcggccagccccatctggctgtggtgatcgagaacgactttcagaacacctaccacagcgcggtcccgccctgcgccgacacggatgccctggacgccgacgccttgatccgccgcattcgggaggccgggctggtgggcatgggcggcgccacgttccccaccgatatcaaggcgaacatcgggaaggtggagaccctgatcgccaacgcctgtgagtgtgagccctatatcacggcggatgacgccctactctgcacggatgcggaccaggcgattcgcggactgcggctgctgcggcagctgctgaagccccggcggacagtgatcgccattgaggacaacaaggagcgggccgtttcgatcctgacggacaagctgaagcagcaggacgaggtggaactggtcgtgctgcccacccgctacccccagggggcggagaagcagctcatccaggcagtcaccggccgccaggtcccctccggcggatttcccaaggatgtggggtgtgcggtcttcaacatcgccacctgcgccagcgtatgccgggccgtggcggacggggagcccatcctccgccggatcgtcacgatcaccggccacgggatcaaggagccgaaaaacctgatcgtccccatcgggacgcctttcgcccacgctatcgaggcggcgggcggcctgcagggggatgtgtggaaggtcatcgccggaggccccatgatgggccgttcccaggcggatctctccacgccggtaatcaagggcaccaacgccattgtggcgctgaccagcgccgatgacctggagtctccccacccctcctgcatccgctgcggcaggtgcgtgtccgtctgcccgatggggctccagccgctgtacctctatcgcttctcccgctgccgggatgtgggaatgcttcggcaatacagcattctggactgcgtggagtgcggctgctgcgcctacacttgcccggggaagctgcccatcgtggcggcgatccgggagggaaaacagcgggtaagggaggaaccatcatgaggtttgccatgtcttcatccccgcatatccgctgcggcgacaacacccggcggatcatgctggacgttttgatcgcgctgctgcccaccctcctggcgggaacgatcttcttcgggctccgctgcctgctgcttgcggcggtatccattgcggccgcaggattggccgaggcgctctggaacaagcttacccgccggtaccagaccgtggaagatctctcggccgccgtcacggggctgctgctggcgctgacgctcccggccaccgtgccctattggatggcggcggtgggtgcggtgtttgccgtcattgtagtgaaggctgccttcggtggcctgggccagaacattttcaatcccgcgctagcggcccgcgccctgctgctgttgctgtttcccgcgtccatgacccgtttcgcggcccctggggcatccgttcccctggacctgggctccgcagacgtggtcacagccgccacgcccctccacagcatggtgatgcccgcgctgccggacgtcccgctttcggagatgttcctgggcagcatcggtgggtgtatcggtgaggtctccgcgctggcgctgctgatcgggggcggatatctggtggtccgcggggtcatcaagctgcggatccccgtcagctatctcggaacgatggcggtcctgagcttcgccttcgcaccgatggaaccgcttcggtggatgctgtacagtcttctgggcggcggggtcctgctgggggccctcttcatggcatcggactacgccacctcccccgccacgcccggcgggcaggtgctctatgggatcggctgcggcgtgctgaccgtgctcttccgctccgtcggtctctacccggagggcgtcacctacgcgattttactgatgaatgccgcgtcctggctgctggagcgcttcacgcccacccgcctgttcggcgcgccgcaacggaaaggaggccttcgatgaaggcaaaagagctgcttgtcagtgccggttccctgctgcttgccggcctgatcctggtagtggctgggaatgccgtggctcccgccgcggccgcaaacgccgcagcggagcaacaggagatgatggagaccctgcttcccggaagcacggtcttcaccccggaagaggacacggggaccgatgccaatattacggccgtctggaaaggggaaggcggctggatcatagagaccactgtggacggctatgccggccccatccgccagtggaccggtgtggacagcaatggccatgtaacaggtctggtggtccgggacatggaggagaccttcggcctgggccggaacgcattgacggacattgattttctggtgcagttcgtcggcacctccggagaggcggaggtgggcggtggtgtggacgcgatcaccggcgccaccgtcacctcgcgggcggttgcccgtggcgtcagttccgcctgcgcgtatgtcaccggtgcagatgtcagcacgtctgcgacagagtggggaggttgatgctgcttgaaaaagatcattgtatcgccgctgtgcacggcgtccatctgcctttccgtgaccttgctggcagcgggtcttgccgcccagattgcagcggcgctggtccccaacatcatcctgcccgcgctggacattcccacgctggcggccctctctctcctcgcgctggtcctggaggtgatcctctttggggagaaccaccggttttgggcaacctcgctgatcgtgggcactgtggcgttcggcgtgctctctctgtgcgccggcagtgtgccgacggtgctggacgcgctgcgggtcgggatcctgggcggcgctgtgttcctgatctgtgaggtactgctccactccatcctggaccggatctcctccggtgccgcgggcaagtaccccaggagcatggctgtggtgtccgcgctgctgctgtggcttgctgcacagattctgatgagtattgggatttaaaactgcggtcggggttcccatacggcagggcagcgagctgcgtggatcggttcgccggtacagtccagctgttctgcaagcccggactatccgttccggtaccggttgtatgcggagcaccggaaggccgaagccgcctgaaaaaccctccatcgctaaaaaacaagggcctccggcaagatgccggaggcctttttcatatccccgagaactgccgtgagctgtgaaaacatcggaccgcagcgaaggattgggcggcaacgtgatcccgcaagctgtgtgttcttgtcaataccgttgcaaacgcggctttgacgcaagccgtttcagctgccggcaggcatttggggatggtagtccattttcccgtggagaccccaccgagtcttccgcacctctgtcccatttacacagggatcaccggcaagcagggatttcaatgcgcctccccgggtggggaaggtctcagtgctccagcagggtgagtcgtttcagaatatgtccgatgtccgcagggatgcagacagaccgcccccgaatctccgggggaatataggactccttctgattgatacaggcataggcagcgctccggttctccagggtcatcttccagaagggatacttgatgatgcccggggtgttgccgcccacccccagctccaggaacagcagccgccgtcccctgtgccgccgtaggaagtcctcgtaccgccgggcggcggcataccagcccgcatcctggacgaaggtatcgtcgcaccgcaggttcatggccatgggacggccgcacctggggcagcgtggcaccagctccgtggggatccgcatgtccctctgttctgcaaacattttgcggacggtctcctcgttgtcataggtctcctgatggcagggcttggagcactgccacaggccatagtcccctgggtgtagaacagccgctgcttgtcgaagcccgccagctggaactggtggtccacattggtggtcaggacaaagtagtccttgtcctttatcagcttcagcagatcgccatatacaggcttcggcgccttttcatagcggtttaccaggatctgccggctccaccaggcccagtactcctccaggctttcaaaaggatagaatccgccggagtacatgtcctggatgtcgtacctggactgaaagtcgctgaaataccgccggaaccgttcgccggagtaggtcatccccgcagaggcggacagacccgcccccgccccgaccaccactgcgtccgcagaggccagggcccccttcagctgctcaatcgggtccgaggagacggcggtagatggctgcgtccaggtctttgaaaacattgaagatcaccctttctacggaagttgtctgctgctccagaaattcccggaccgttctcacggcgatctcggcggcctcctggtttggaaagtggaactccccggtggagatgcagcagaaggccacactgcggagaccatgctccgcggccagcgccaggcaggagcggtagcaggcggccagctcccgccggtccttccaggtcacccatctgcccacgatgggccccacagtgtggagcacataccgggccggcaggttataggcacgtgtcagcttggcccggccggcgggctcaggatgcccctgggcccgcatgatttctgcgcacgcgtcccggagctggagccccgccgccgagtggatggcgttgtcgatgcagccgtggcagggggcgaagcagcccagcagagcggaattatctgcatccacaatggcgtccgcccgcagccgggtgatgtccccctgccagagcaccaggcggggatctcctgcagtgggaggcagggcatccccgttcaccacgcccttttcctcccgctcggcggagagcagggcatcctggacttccagaaatttgggggccaggggcatgggcggccggacattcatcagggagcggagcagccgccgctgtgagaatgcatccaccggaaatgcttccgcctgctcccggtactgaggcatttccgccagaagggtttgattcaaatattgtacctgttccctgcgatccatgggtctcctccaaaggaaagattcattgtacggtctgataccggaaatgccagagcggagatcggcacagagcccgcttcccggcacttgcagagggcgtccccttctgcgggaaagcgcaggctgcttcacccctcgctttctattgtacggcgggattcaccactcgtaaagtacgcacaatgctgtgacataggcaccgggaggtaaccaaggggctgcggggctttccacggggcgaaatttttcatcgccgccccatgggagcttgacaatcgctctgcaggtaccataaaatatggatgatatcagaggatttgaagtgatcggtatacaggagggacctgcagatggcagccgcggcaaaagaacttccggcctgtccggtggaaaccacgctgacgctgatcagtgacaagtggaaggtgctcattctccgggatctgatgccggggacaaagcgttttggagaattgaagaagtccatcggctcggtcagccagaaagtgctgacggcccagctccgggagatggagcggagcggcctgctgacccgtacggtctatccggaggtcccgccccgcgtggaatacacgctgaccgacctggggtacagcctgaaacccattctggacgccatgaggaactggggcgaggcgtataaggcccaaaaacaggggtagccctccctcagcgtcaagccgcctgctttggcagcctttgcggggcggtcccgaaagagccccgacccagcaaaaaacagactgctcgtgcagtctgttttttggatcccgccgtcccgcagcggcagggcccgcaagggtgcaggcttcctcaaaggggaaacgactccattaccagagtcaggagcgggatcgtcaggatcgaacacagggtggaggcaaacgcgatctgcgaggcaaagacggcgtcgcagtcatacttgtccgccagaatagagcccgtgctgccggcgggcatccccgtcatcaggatacagacattggtcagcgtcgtgtccaggtggagcggtttgagcagtacgcacagcagaagcgggtacaggaccagccgcaggcaggtgtaccacagaacaggctttgagaacatggagcggatgggggcgtccgccaggattgtcccgatgacgaacatggagaccgggacggtgcagctgctgaccgaggcgacggcgctgtccaggaagcccggcagggacaccggagcggccatcaggagcagccccgcgaaaacggcgatgatgcaggggtggcggaccagcttgcggaaggcgtccttcctgctgacgctggtgaagagggacagccccgccgtccacatggtgaagcggagcgggatctggaacatggacgtgtagatcacgcccagatccccaaacagcaggcgggccaccggcaaccccacaaagctggagttggaacagatgatgccgtaggagagaacgctcctctgctcccgagggtactttcggaagagcagcttgctgccgtatatggacatcagctggatgactgcggaaagtccaaccgccagcaggcagttccgggcgaagccgtctgggaacaccatcccgcctaaaaaggactcgacgatattgcagggcaggatcacatcgatcagcaggtcggagagcatcttccgccccgccgcgtcgatgatcttcagctttttgatgagtacgcccgtcaggatcagaaggaacatcgtctcctgcagggacagcatctcccagaaaaactccatccgcacgcctcctgtccggtcccccgcaggccccggtctgcattgttattcattatataccacccagacgggattgcaagcgccggacacttctgtgcttttgtcacagaaatcccggtcggcgtgtggtatactctttttaaaagagccgccggacggcccggctcccggtgccgggagccccgccgcagcagcggcgcggacagaaaggatgcgtatgatgggattctttggatttctgcagcggccggacctgggacaggggctggagcggtttgccgccacgccgaacgccctgctgctggacgtgcgcacacaggaggaatatgcggacggtcatattccggagagccggaatctgccgctgcagacgttggggcggacagagcttctgccccccgcccgggagacgcccctcttcgtctactgtctcagcggcgtcaggagccgtcaggcggccggcctgctgcggcgcatggggtatactgatgtgacggatctgggcggcatctgcaactatcgtggaaaggtggtcaagtgagatgaaagtcatcattgtaggcggcgtggccggaggcgccaccgccgcggcccggctccgccggctggacgagaccgcggaaatcgtggtatttgagcggtccggatatgtatcctacgccaactgtggtctgccctattacatcggcggcgtcatcaccgacaaagaggagctgacgcttcagacgccggagagcttctggcagcgtttccgggtggacatgcgggtgcgccacgaagtcacagccatccacccggcagagaagaccgtggacgtgcggaatctcgctaccggcgagacctttaccgaatcctatgacaaactggtcctctcccccggtgcccggcccacccagccggcgctgcccggcgtagggatcgaccgcctgttcaccctccgcacggtagaggacaccctgaagatccgggaattcatcgaacagcaccatccccggtccgcggtgctggccggcggcggcttcatcggcgtggagctgatggaaaacctgcgggagctgggcatcgacgtcaccgtggtccagcggccccgccagctgctgaatcccctggacgcggacatggccgccttcctccacgccaagctgcggcaaaaaggggtgcggctgcatctgggctgcactgtggagggctttgccgccaacggtgaccgggtcaatgtgctgctgaagaacgaggcgcccctcaccgccgacatggtggtgctggccatcggcgtcacgccggacaccggcctcgccaaggcggccgggctggagctggggatcaagggcagcatcctggtgaacgaccggatggagacctccgcgccggacatctacgctgtgggggatgcggtacaggtgaagcacttcgtcaccgggcaggacaccctcctctccctggcgggccccgccaacaagcaggggcgcatcgcggcggacaacatctgcggcggagacagccggtatcccggctcccagggcagctccgtcatcaaggtattcgatatgaccatcgccaccaccggcgtcaatgagaagacggcaaaacaggcgggcatcgactgcgacaaggtctacctctcccccatgagtcacgccggatactatcccggcggcaaagtcatgaccttgaaggtggtgttcgagaagggcacataccgcctgctgggcgcgcagatcgtgggttacgagggtgtggacaagcggatcgacgtgctggccacggccatccatgcgggactctccgccctccagctgaaggatctggatctggcctacgcgccgccctactcctccgccaaggatccggtgaacatggcaggctttatgatcgagaacctgtcccatgggctggtggagcagttcttcccggaggatgtggacgccctgccccgggacggcagtgtgacgctgctggacgtgcggacccccggcgagtacgccgacggccacgcggagggctttgttaacctcccggtggatgacctgcgggagcggctgcgggaagtcccggtaggcaagccggtgtacgttatctgccagagcggcctgcggagctatatcgcgtgccgtattctggcccagcaggggttcaaatgctataacctctccggcggctggcggctgtatgagacggtggtgcgggaccggaccgccgcacaggaggcctggccctgcgggatggagaagtaaacaggaaaacgcaagccacccgctgcaaaggcagcgggtggcttcattcatgattgatttcgacggaaaggacatcttgagtagcatctttctgcggggctgcacgacgcgccgcccgatcctgccgcagggccgccaggatccccaaggatatgatcccgcacacatagagatactgaaatccctcatcgccgccgctggaatcaaaaaagtggacagaggaaaaatcgtcatccggaaacaccagaacaccgcagtaccgtagcagtccatagatcattcctgcggccagaagggccagcccgatcagaaggcacaccctgacgatctgccgaattcgcggccctttccgctccagtccccagcgggcggcggcaaagcagagaatgccgcagggtaacgacagcggcagatacgtcagtgcttccaccagaaacagcttcatatcggctcccccttttccactatgatacacactctttggccggaagtcaacaatgccctccggcgcggggcggaggcagcgagttcgctttctgatgaaaaaacaggacacccaaagctgggtgtcctgtttcactctggagcgggcaacgaggctcgagctcgcttcccggcatcccgcgaatggctgaccgccattcgcaggacccctgcctcacctctgatccaatcgcgccttcggcgcggggcggaggcagcgagttcgctttctgatgaaaaaacagaacacccaaaattgggtgtcctgtttcactctggagcgggcaacgaggctcgaactcgctacctccaccttggcaaggtggcgctctaccagatgagctatgcccgcggaacaagaggtattctaccagagaaacacccgcttgtcaagactcttctgcaagattttccgaattttcttccgcagcagccgcggcgtctccgcccatcacaaactcgatcagccccaccggaccctgtgccggataataggagatcgtccagggcggcgtctctgccagacctcgcgcctcccggagctgtgccaccgtctcctccacccgggcctggccgtcctctccccaatagccgacccggaccgccagctccgtgcggccctcgtccagcgccgcctccagcagggcggacagcgcctccgtactggtggcgttcaccaccgcctggatctgctccgccgtccggcggtagctgacctggatgctgatctcatagtacccccgctgggaccggctggaggcggtgatatactccacggcataggcgcccataggcgtctcctgctggacctccgtagtggcctgctccagtgtgtccgccaccgtcagatcgtcctcgtagttgtagaggcggaccgtggcgctctccgtgtgctggccgatgaggatcagcaggtcgttcacgatgtcctggtagttctccgcccggagagtcccggcggcctcgctctcccagaacttgctgctgtggggctccacggtggcatagttccgctccagcagggcgctgcaccccgtcagggacaggctgacgcacaggagcagggtgagatggcgcatcttcacggctcggcgcctcctttccggtcagaatggcccagggacgggcaggggcgcgcttacagccccaggtcctcgtccaccagcaggacctccgtctccatgcccagcataggcccccagagagtcaccaaggcgcggcagacccgctcaggactccggcagtcgtagcagcggtccgccttcacggcgcagggcgtcttcttccccagctgccgggcgcgctggggtgcagccacgttccgggcccggtacaccgccgcctcgtaggtgggggccagcttgttccggccgatgacaaagtacaccttctcatggccgaacagcgtagcggacacccggttgccggtgccgtcgatgttgacgatctcccccgactccgccaggccattggcagaggacaggtacacctgggtctgcatggccgccttccgggcggcgttcgcctcctgcttccagtgccagatgacggtgttgtgggccgccagcttgtcgtacacccccagagcgtccagggtggcggagccgccgaagcccacggtcttgccgtcgatggcgccgtccaggtaggccgcggcctccgccgccgccgcaaaggtgcgtacggtgtagccccggcgctccagggcctgctgaaccttcgtgaaatctgtcatgtcaaatttcctccttctgataatccccaaatccctcgcccaggatctcatgggcgtcgcacacgatgaaaaaagccttcgggtcgatctcccgcagcatccgcttgatgggcacgatctcccgctgcctgaaggccaccagcagtacctgcttctccgcgccggtgtatgcgccttttccctgaagcagcgtcacgccccggttcatatccagcagtccctggaccgtctcctcccaccggtcggtgatgatgtaggccacacgagaggtatcccacccgtacaggatcatatccatgaccttggacagcagatacatctgaatcaagccataaagtgccgcgttgacggtgccgaacaccactgcagccaggatcaccaccaccatgtccgggatcatcaccagcttaccgatgggcagccaggggaatttcagcttcagcagcttgccgatgatatccgtgccgcccgtcgtggccccctgggagaataccaatcccagccctacccccatcccggcgccgccgtacagggtcgccaggatcgggtccatcgggggaaggtatgcatccatgcaatcacgtcaatggccaaggaactgactgccatggcgtacaggctgctcaccagcaggcggcctcccagcagccgccagcccgccagaaacagcggcacattgacaaggatggacagcactcccaccggcaggaccggcaccagggcgttcacgatctgggccagacccgtcacgccgcccatggcgatctggttgggggctacgaaccagtcaaatgccagggcgtagatcactgcccccagcgtgatgataccgcagctcctcaccttctgcgccatagatctactccttttctatctgattcagtccagcagatccatctgccgctcctcggagtcctcctcccgcagcagggcgcccgccgccgggagactgcgcacccggtagcggctctggttggtgatgggcgtgtcctccagcgccttcaccgtctccagctggtactttggcttcagggtcatcaccgccaccccctgggtggtgcgggtggtcttgggagccagcagagcggtgtggaaaatcagcgcccggggctccgtggagtacaccgccagctcgcagtctgtatccagcctgcggatacaggccaggggcgccttgtcggagtaggcccccgtcagcttgcggcggttggaggtggtcttgtaggcggtcaggtccacccgggccgccttgccgtttgcaaagaagaacagcagggccccggcgtagtccggtcccggcaggacggcgtagatcacattctcgccgctgtccatggagagtttcgcgggcagatagtcccccaaggcgctggccttggtgtcttcaaactcgctgaggcgggtcttgtacacctggcaccggtccgtgaagaacatgatctccgcgccgttggtggtctcaaaggtctgggacaatccgtccccgtccttgtacttctggtccgccgccattcgcaaagaggcgggggtgatcttcttgaagtacccctccctggagaggaacacatggacggagtagtcctccacctgagcctcctccacataggtctcgatctcgtggctgtacacgatggaggttcggcggggctcgccgtatttcctggccgcctccgtcagctcgtccaccaggatctgcttcagccgccggggggagttcagggtgtcctccaggtcggcgatctcgtcctggagggcgtcggtctcgttgacacgcttgaggatatactccttgttgatgttgcggagcttgatctccgccacgtactccgcctggatctggtcgatgccgaagccgatcatcaggttggggatgacctcggcctcctcctctgtctcccggatgatttggatggccttatcgatgtccagcaggatccgcttgaggccctttaagaggtgcagcttgtcctgtttcttcttcatcacgaagtagacccgccgccggacggacccggtccgccaggcagtccactcctccaggatctgccgcacccccagcaccttgggagtaccggcgatcagcacgttgaagttgcaggcaaaggcgtcctccaggggtgtcagcttgtagagcttggtcatcagcttgtccgggtccacgccccgcttcaggtcgatggccagtttcaggccggagaggtccgtctcgtcccgcatgtcggcgatctctttcgcccggcccgccttgatgagctccgccaccttgtccaggatggcctccacggtggtggagtaggggatctcgtagatctcgatgagattctcctctttgacgtagcggtacttggcccggacccggacgctgccccggccggtctcatagatctcccggatggtgttccggtcgaagatcagctctccgccggtggggaaatccggcgccagcagggtctccatcaggtcgcagtccgggttcttcagataggcgatggtggtgtcgcagacctccttcagattgaacccacagaactgggaggccatgcccacggcgatgccgctgttggcggacaccagaatgttggggaaggtggtgggcagcagggccggctccttcatggtgttgtcgtagttgtccacaaagtccacggtgtcgctgtcgatatcccggaacagctcggcgcagatgggcgtcagcttggcctctgtgtaccggggggcggcccaggccatgtcccgggagtagaccttgccgaagttgcctttggaatccacaaaaggcgtcagcagggcgccgtagccccgggagaggcgcaccatggtgtcgtagatggcggcgtcgccgtgggggttgaggcgcatggtctggcccacgatgttggcggacttggtccgggctcccgtcagcagacccatcttgtacatggtgtacagcagcttgcggtgggagggcttgaacccgtcgatctccggaatggcccgggagacaatgacgctcatggcgtagggcatgtagttggtctccagcgtgtcggtgatgggctgttccaccaccgccgcgtgaaggccgatgacgttggacgcgtctaccttatgcttgttgtcgtcggtttttttctttttgggcaagtgtaatcagtccttatcttgtatccatttcaaggggttgttgcggatgtactggcgaacattggctaggtcctcgtcattgcggatcacatggtcataaaagcccttctgccaaagagaaatgcccgcttacttgctggtgatccgcttcatctgctggatgacgttcgacagcggcgtaggggcggcaatctgccgctcgtccggcccgatgtgccggagtgccaaaatcaaatgcacatggtccggcatgatgatatattgatctaccgatatgccggggtagtgatccgggatcgctcggatggtttcatccacgatccgccccagaggtgtcagggagattcgaggcgggcgattgataatcgcccctacggcgggttcgatggaacacaggacctcctgattccgctccctggtgcagatggtgatgaaataagatcccggctggctgtaatcataggactccagccgcaggcgcttccgctgggggcgttccatggcatcctctccgctatccgttgattgggagtgtattttccgttgtcgaaacagagggtgctttctgtcccaacggctacgcatttattaacccaaacagccaaaatacttgaaataattcacgtattgcgcattttccgaaactctagtatgctgtattcataaaattcaaaggaggctgctccatgaatgagacctataaatggctgtatgactactacgccctgccgttgatgaaagtcggcaaacaggcggatgcgctcaaagagcggatcgtctcccacggcagccctgcggacgcgctgttcctgtgggaccggctggaagacctgtgcctgctgtggggcacggagtcctttgccatcgggctccaactgggcctgcggctcatggcgggccagcgggcggacgggctgctgatctcataaaactctcacgaaatatccgccatctccaggtacttgtacccgttctccgcaatatggtccttccggccctggaggttgtcccccagcagcaggtcgaacaccgccgccgtctgctccacgtcctccggcatcacccggatcagccgccgggtctccgggttcatggtggtcagccacatcatgtccgggtcgttctcgcccaggcccttggaccggtcgatcttgtacttcttcccctccagggatttcacgatgtcgttcttctccttgtcggagtaggcgaaccacgtcttgtcgccgctgttgatctcaaacaggggcgtctccgcgatatacacgtacccctcccggatcagggtgggggtcagccggtacagcatggtgaggatcagcgtccggatctggaagccgtccacgtcgccgtcggtgcagatgaccaccttgctccaccgcaggttgcccaagtcaaagggcgccacgttcttcacgtgcttgttctggacctccacgccgcagcccaggaccttgatgaggtccgtgatgatctcgctcttgaaaatccgggcatagtccgccttcaggcagttcaggatcttgccccgcaccggcatgatgccctgatactcggagtcccgggccagcttcacgctgcccagggcgctgtcgccctccacgatgtagatctcccgcttgtccacgtccttggtgcggcagtccacgaacttctggacccggttggcgatgtccaccgagccggagagcttcttcttcacgttcaggcgggtctcctccgccttctcccggctgcgcttgttcagcagcacctgctcgccgatcttctctgcgtcaaaggggttttcaatgaagtagatctccaggttgctgcggaggaactccgtcatggcctcctggacgaatttgttggtgatggccttcttggtctggttctcgtagctggtctgggtggagaagttgttgctgaccagcaccaggcagtcctcgatatccgcccaggtgatcttgccctcgctcttctggtacttcccctggtcccgcaggtacttgtcgatggcggagacaaaggcggacttggccgccttctccggagagccgccgtgctccagccaggaggagttgtggtagtgctcgatgacgttcaccttattggaaaagcagcaggccacgctgagcttcaccttgtactccggcttgtccgcccggtcccggcccttcttctccgtctgccagaacaccggcgccgtcaggctcccctctcccgcaagctccgtcacatagtccatgatgccgttttcgtagaggaactccgcctcttcgaaccgacccggctctgtctcgttccggaaccggaaggtgaccccggcgttcaccaccgcctggcgcttcatcacgtcggtgaagtactccgccgggatggcgatgtccgtgaacacgtccaagtcgggaagccagcgggtgcgggtgccggtttttctggcctggctcttgagcaggggcgccttccccagctcccccacgatctcgccccgctgaaagtgcagggtgtattcaaagccgtcccgccagacggtgacgtccatgtaccgggaggcgtactgggtggcgcaggcacccaatccgttgagccctaaggaatattcgtagttgtcgccggagacgttgtcgtacttgccgccggcgtacagctcgcagtacaccagctcccagttgtaccgctgctccttctcattccagtccaccgggcagccccggcccgcgtcctccacctggatggaccggtctgcaaaccgggtgacagtgatggtccggccgtggccctcccgggcctcatcgatggagttggagagaatctcgaacaccgcgtgctcgcagccctccagtccgtcagagccgaaaatgacgccgggccgcttccggacccggtctgcgccctttaatgccgaaatgctgtcgttgccatagtcctgcttcttggttgccattaagttcctccaaaggcagtgtctgccgtaaaattcataaatttattgtagcacacccggcgctgtccttcaagtgctcccccaaaagacgccgtgatcccgcccgcttcccgacgcttcacacaaattttacaaaaatgttattgcgtaaaatttctcataacctggccgtcacccagctcaatgcccttttcatcggggttttgcacattctccacagagttttccacaccgttatgtcaacttttgaaatacgaaaaaaataccgcgccgcgcacaccccggccggacgctccgtttttcggatcagatgcttttacagagcgccttttcagccagccggatacccggaatttttttgtagttgcaaatgcaatatatgcgcacatttggatatgctaatatattgccagaagaaatccctctccccttgaaagtatttcaaaaaacggaaaaaggagaattctatatgaagttctatatctgcaaacattgcggcaatgtcatcaccaagctcacctccgcccaggtgcccgtgaagtgctgcggcgaggagatgcatgtgctggaggccggtgtcaccgacgccgcccaggagaagcacgtgcctgccgtcacggtggagggcagtctggtgaaggtggacgtgggctctgtcacccatcccatgaccgccgagcactttatccagtgggtggtggtggagactgagcgggacgccctgatccactggttccacccggaggagacgccggaggtcgtgttcgccctggcggagggccagactgccaaggccgtttatgcctactgcaacctccacggtctttggaagaaggacctgtaagctgcgagacaccagaccgccccggcgctgcacagcgccggggcggtcttctgacttttgagatcggatatatttaggatataggaagcctctgtgggtgcagcatccccaaagcgggacggcatggcattcccgcttcagccgagcagcaccaggaccacgccgtaaatcaccgaggccagggtgccgaacacgatcaccggcccggcgatcaggaacatcttggccgccatgccggtgacgaatccctcgctgcggaagtcgatggccggtgagaccaccgcgttggcaaagccggtgatgggcaccagcgtcccggcgccgccaaagcgggccagcttgttgtacaggttcagccccgtcagcagggcggagagaaacaccagcgtgcaggaggtggcggtgcccgccgtcttttcctccaggccggcggcagtccagccgttcaggatcagctggcccaccacgcagatggccccgcccactacaaaggccaggaccgtatccttcagcagcggcgacttggggccttctgcttcacatactgctggtattcctgcggcgtcatattcattgaaaatcccctccaggccattttcccatagggtctcctgcttgttcggaaactatacgcacttgcaaacctgcgcggaagggagtacactgttgcccgaagatttgtgtgtttggaggaatccccatgagacccatgcccgccccgctgggcctgtatatccacattcccttctgcaagagcaagtgcgtctactgcgacttctactccctgccccggtccgagagccggatggacgactacacggatgccctgtgcgcccatctggcggagaccgcccccttcgcggcgggccatctggtcgacaccgtgtacttcggcggcggcacccccagctatctggggaccaagcggctggtgaagatcctgaagaccattctgaaaaaatacaaggtggacaagcaggcggagatcaccctggaggccaatcccgactccgccggggactggaaagagctgcgcaccctgcgccggtgcgggttcaaccgcctctccctgggaatgcagtccgccgatgacgaagagctctcggagatcggccgggtgcacaccatggctcagacggaagccgccgtggaggccgcccggaaggccaagttccagaatctctccctggatttgatttacggcctgccccatcagacgctggaggggtggcagaaaaacctttccgctgccttggacctgacgccggagcatctctcctgctatgggttgaaggtagaggagggtacgcccctttttgcccggcgggggaccgcgggtctgccgggggacgacgcccaggcggacatgtatctctacacggtggagttcctgaaggcccagggctatgagcagtatgagatctccaacttcgcaaagccgggctgcgcctcccggcacaatctgaaatactggaccctgggggagtacgccggcttcggccccggcgcccactcggacttcggcggcgtgcggtacgcctacacaaaggatctggagggctatatccggggcgtgcgggaccacgcccccatgctgtcggagagcgaccgcatcccacccctggaccgggacaccgaatgggtaatgctgggcctgcggaccacggcgggtttggaccccaaggcatttgagcgccgcttccgccgccggttcacctgctttctgcccttcctggaccagtgcgccagggccggctatgcggtggaggaggacggccgctggcacctgacgccccggggctttctggtgtccaaccagatcatcggtgggatgctggatgccctggccgcggacaaacagcggcgggccgatgccgccgcccggggagatttccgggtgaacctggattgaatgaaaaaagccgcccgctggaatgctccggcgggcggttctttctcatgccttccgggcccggatggcattgaccgggcagccgttggccgcgtcgaaggcccccgcctcctccgccggggtccggggctgggcctgcaccacggacacccgcccctggatctgaaacacggccggcaccgccgccgcgcacatcccgcagccgatacaccgggaggcgtccacattgactgtcatgcgcttcctccttttccgcgggctgcgcccgctgttcccttttattgtaatacaccgcgccggtttctccaagtcttttctgcggcgggcggaacttttttcccgcagacgccgtcttgtatttgggagactctgtgcaatctggtggattttgttgccccattcccatttacttttccgcctgtttatgctattctgaagaggattatgtagaccatctcagctgcagcttatggaggtatgacatgaaaaacaccctgcgcaaaaccctgtccctgtttttggcgttcacgcttctttgctccctgggcctcaccgccgccgcgtccgaggccatgggcgaggacctgacctccaagggcactcttttgaaccagaagacccagctctccaccaatgtgttttggagtactgcgtactccgacctgcggacggagaacgtcgtcacatacgagcccaatgcagatgtgacgcccatcgtcaccttcggggactccctgaccacccgcaccacggtcacctctgcggcccgggcactggagagccagggctaccgggtggcggcgggcatcaacggcgacttcttcaacacctccaacggcctgcccatcggcatcctggtgtcggagggagaggtcctcagcagcgacggcggctactacgccatgggtttccgggaggatggctctgctgtcatcggcaagcccggactctccatctccgccaacctgggctatcagggttcggacagcagcgggtacttcacggacatcatccgcacggtggccggcatcaacaaggcccgggtctccaccggcggcatctacctctatacatacgacttcaacaaccggcacaccaccggcaataccgaggccggcgtggacgtgctgtgcaccatcgtggacggctccctctccatcggcggcaccatgacgctggtggtggaccaggtgatcgaggccacctccgcaacggccatcgggccggaccagattgtcctctccgccaacgccctctccaacacctactacaccgacgccctgcggaacatccctgtgggcgccacggtgaccgtcaccgtctccgccgccaatgaggcgtggaacgatgtgcagtacgccgtgggtgccttatactccctggtgcaggacggcgccgtggtctccggtctgccctccggggtgaacccccgcacggcggtgggtgtgacagctgacggcaccgtggtgttctataccatcgacggccgccggtccggccactccatcggcgccagcctgagccaggtggcccagcggatgatcgagctgggctgcgtggccgccatcggcctggacggcggcggctccaccaccatcaccgtgacgcagcccgacgacaccaccgccgctaccatcaaccgtccctccgacggcagtgagcgggcggtggccaaccacctgttcctggtggccaccaatgagcccaccggcgaactgggccacttctacgtccaggcggacaacgcctacgttctggcgggcagcaaggtagagatctccgccgccgccgtagacaccaactacatccccatggacgaggactatgactacgacctggaggcctccgacggggagctggacggcaatatcctcaccaccccgaaacggggcggtgagatcaccgtcaccgcctccagcggccgcagagaaggctctaccaccgtctacgccatcgaggatcccacggacgtggtgatccgggacagcagcggcaccgcgctcaccacgctgaatgccgccaccggcaccaccacccagctggccgccaccgccgcctacaaccacatctccctgaaggcggatccagaagccttcacctgggaggtcaccggcgacatcggcacggtggatgagcacggcctctttactgccgccgcgcccggcaccggcaccatcacggtctccgccggccgggccagagtctccatccccgtcaccgtctccagctccggcacggtctccgccggcggcgtcatggaggtggagtcctttgagggcagcaccaccatcttccggggcagcggcagcaacatggacttcagtctgaaccacagcgccgacaccgtgcggatgggcagcggctccgccaaggtggattacactcttaccgaaaccggcgcatcccaaggcgcctacaccgccgagtggcgggcctccaagtccacgggcatcgactgcagcacctatactgccctgcacctgtgggtctacggcgacggctccggcaacatcctgtccctgctgtacaacgatggcgccgcaggctatcagtccctccaggtaaccccgctggacttcaccggctggaaacaggtcaccgtcaccctccccggcgcacacttcgagattcagggtctgcaggtcagcgccaccaccgccgcagacggtacggtttctgtcggcgacaagctctccggcaccatctatatcgaccacatcaccgccaccgcctccggcacgccggacaacgcggcgcctgtggtctccgcctccctcgacaattccctctggcaggtgaccgcctcggtcgccgacgcggtggatggcatcctgccagcgggcagcgtcaccgtcacctacaacggcgccccctacggcagctatgatcccgccaccggtcttgtgaccgtggccctgcccggccccggggagagccacgaggccatgcggatcaccatcaccgcccgggacctctccggcaacatcggccgggcctccgtggatgtggagccctacggcgtggaccacaagttcacggacatcaacgactactgggcggccacctatgtggacttcctgtacaacgccaatatcaccaccggctatgccgacggcaccttccggcccaacgacaacatctcccgccagcagttcgcggtgatgctgtatcgctacctggggctggacggcacccagtatgagagcgtgacgctgcccttcgcggacaacgcctccatcggggattacgccctgacggcggtgaaggccctgtacaccgagggcatcatcaacggctccaccggcagcgacggacggctgtacttcaatcccggcgggtccctgacccgggcccaggccgccgccatgatcggccgtacccaggagaagggctacgccattgtcgatctgaccttctccgacaccgcctccatccctgcctacgccacctactacatccagaccatggcggcccagggcgtcatcagcggctatgcggacggcacgttccagcccggagccaacatcacccggggtcagatggccaagatcctctacaacctgatgtgagtttcgcctttcagaggccggcgcatccgcgccggcctctccttatggagagcgtcttttcggaatctgccgggtgctgcaaagcgctatcgactccaatcccctgtgatttcaggaaagggtctcccccggggcccgtccaggcaaatgccgccgggcacagcccttcccggtcggcctctattcaggcggccagggctgtccggtgaagccggaagatggaaacggtgcctgttgacagctcctgccccagggtgtaaagtaatcatattccacatcctgtccgcggacaggatgtctctttgcgaggaggccccccatgaagctgagacgttccgcctgcattgacacgctgtacctggagctgcccttcctggaccggttccaggcggcaaaggaggacggctttgacgccgtggagttctggagctgggcggaccgggacctctctgccgtcaaatcggcatcagatcgggccgggatccctgtctgcggcttcaacggggacgcggacctctctctgatcgaccctgcccagcgggaggcgtatctggcctttctgcaccgctctctggaggcggcccggttcctgggcgcctccggcgtcaccgtccactccaacggtctggggctggggggcgtggtgctggcgccccgggaggacctctcccacacggtgaagctctgctccctgtacgcgggccttgccgccagcgcccgcctggcggaggaggcaggcgtcaccctctatctggaaccgctgaacatctccacagaccaccccggtaattttctgcgggacacgcagacggcggcggagctggtacgcctgatcggctctccccgcctgaaggtcctgtatgacatctaccacatgcagctgaacgagggccgcctctgcgacaccatccggcagtacgccgataccttcggccatgtccacgcggcagacgcccctggccgccgtgagcccggtaccggggagatcgccttcccccgggtctacaaggcgctggaggccgccggctacacagggctggtgggctatgagctgtttcccgcccgctccacccgggaggctgtaaaggccattctggacgccggctgacacgttgaccggtaccccctgtattctgcgaaaaaggacggatccaacaagatgcactccataaaaatcgctctctcccgctatggctggttcactgccggggtcctgctgaacgccttcggcgtggccctgattaccaaggccgcgctggggacctcccccatctccagcctgccctatgtgctgagcctccgctttcccgtcacgctgggacagttcacttttttgatgaatatgctgttcattctggcgcaggtcctgctgctgcggaaggacttccgtcccgttcagctcctacaggttgctgtgaatgtggtgttcagcctgttcattgatgtgagcatgggactcctctcctggatggaggtcggtgtgctgcccatgcggctgctggcgctggccgtgggctgcgccgtgctgggcttcggcatcagcgtcgaggtggcgccccgggtgctgatggtccccggcgaggggatcgtccaggccatcgcagtcgtcaccggccgacagttcggcaatgtaaagacggctttcgacgccacgctggtgtccacagccctgctcctctccctgctcttcttccatcagctccagggcctggagatcggcaccattttttccgcactggcggttggccggttcgtgaacctctataaccggagactgccgctgatctcccgcatctccgccctgggtgcaagaacctgaaaaatcagtgttgcatcccttccgttgttatggtatattagcagataagtaagttggcctgccggccaggaaggatctgtgaacccgcgtggacgaacctccgttgcccacccatacataccgaggtgtctttcagaaggacagtctgccccaaggggtgagactgcccttttcgcgttttgggcctcagggatccgctgatttttttgaggagtgatgatttttcccatggacagttccactatatcaatgaccgtggccatcgtcctgctggtgatgatgtcggcctatttctccgccacggagaccgccttctcctgcctgaacaagatccggatgaagagccgggcggagtccggcgaccaccgggctgctcttgccatggacctggtggaggactatgaccggctgatctccaccatcctcatcggcaacaacatcgtgaacatcaccgcctccactgtgggcacagtgctgttcaccaagctgtatgcggcttacggccccaccgtctctacggtggtgttgacgctggtggtgctgatcttcggcgagatttcccccaagagcctggccaaggagcacgcggagagcttcgccatgttctccgcgcccatcctgcgggtgtttctgctggtcctgcggccactgaacttcctgttctcccagtggaagcggctgctgaacatgatcttccacccctctgaggaccagggcatcacggaagaggaactaatcaccatggtatccgaggcggagaacgagggaggtctggaccagcacgagagccagctgatccgctccgccatcgagttcggcgacctggaggccggggacatcctgacgccccgggtggacatcgtggcggtggaggactctgcctccatggaggagatcgccgccgtgttcgctgagagcggctactcccgcctgccggtgtaccacaaggacgtggatgacatcgtgggcgtgatccatgagaaggacttcaacgccgcccgctaccggggccagggcaacatctccggctgcatcacgccggtccactataccaccgccaatgcggacctgggcctgctgctgcggacgctgcagaaaaaaaagacccacatggccatcgtggtggatgagtacggcggcaccgagggcctgctgaccatggaggacatcctggaggagctggtgggcgagatctgggacgagcacgatgaagtggtggagtccttccgcaagcagagcgacggcagcttcctggtggccgccggcgccgacctctccgacttgtacgatctgttctccatcaagggggactgcgacgccagcaccgtctccggctgggtgatcgaccagctgggccgcctgcccctggtgggggaccacttccaggcggagggcctggacgtcactgtgaccatggtggaccaccgccgggtgctggaggttcgggtggccgtggcggcggaggcgccggagaccgcggagggcgcggcacagcactgaccggacgaacccgccgcccgtcccgccagagccccggcgggacgggcggctccctcatttgaaaccggaggtcttatgtacgtctattccctgggacagtggctgctgttcttctttctctactgctttctcggctgggtgtgggaatcctgctacgtctccgccaagcggcgccagtgggtgaaccgtggctttcttcacggccccatgctgcccatctatggcaccggcgccgtcatcatcctgctggccaccatccccgtgcgggacagcctgtggctggttttcctgctgggcatgctggccgccacggcgctggagtatgtcaccggtgccgccatggaggccctcttcaaagtccgttactgggattactccaagcagcccttcaacctcaacggctatatctgcctcaccagctccctggcctggggcgccttctccatcctgctggtgcggtttctgcacccgcctgtggaggatctggtgctgcggctgcccgccttcctggtggatcctctggcgttcctgctgaccatcgccgtcaccgtagacgcagtccggtccttccaggccgccatggacctgcgggaggtcctcacccgcctcacggaggagaacgaggacctgcgccgccttgccaagcgggtggaggtgatctccgcctttgcggaggaggacctgcgccgcttccgggagcgcacggaggtggagcggctgctccggcaggagcgctgggaggacacccgccgccagattcaggaggcctatgccaagggcgcccgacgccgccaggcccagctggaggagtccctgcgccgccggaccgatgccaagctgacggcccttgccaacatccaggaggctctggaggcctaccgggaccggctggcagttgccagggacctgacagaggagtctctggaggcccgccgggcggaagtccagcagcttttggaccgactccgggaccgggaagcttccatccgcgcccgcaccgccaggcgttatcgccagtccctgcgcatcctgcggggcaacccctccgccagcgccaaagcctttgccgaggccctggagtccctgcggaagctgggggatcgccgggaggggaggacggcgaatgaggaaagccggcgcagcagcccctgctctgcagagcggtcgttggttccatacggagcggacgtcccttcttttcgtgtccccttatagcaattctccatctctgtctgaaccgacgatcttatacaaacaaagcggcacagccttcggctgtgccgctttgtcgatcaggatggcagcgtggacttgttctccgcagcgggcgggtccgcggggaaatccagaatccgccggatgcacagggcatagactgcgatgctcaccaccggccccgcgatgtcggagatgggttccgcatagaatgcggcccgggcgccgaataccgccggcagggcaaacagggcgataaagtacaccgccttccggaaggcggacaggggcagggccagctgtacctttcccatgccggtgaatccgtccacaatggcgtactgcagccccagggggatcagggccagggtgcagatgtggatggcggagagggcctccgctgccagctccggctccgtggtgaagaggcgcacgaagagagctccccccagacgggccagcagaaacagggccgtcacataggccacgcacagtccggcgatgaatgcctgggccttcaggatccggtcccgccgccgggcgccgtagttgtacgccaggatggtgcctgtgccggcggaaatgcctcccaggggcatggtcaccaccagcatgaagctctgggcgatggtggcgcaggtcaccagacggtctcccagctccgccccgccataggactggaggatggcgttcatggagataatcatgatgttgtccacgccgatgatgaggaagggcgtcatgcccaccgccaggatgcggagcatcagccgcccgtcgtaaccgccgaaagtgatggcgatgggcacagacttgccgaagaggaaccgcagtacatagaggcagctaaccagctgagagaggaccgtggccacggcagccccagccacccccatgtcaaagagaaagatgaacaccgggtccagcacgatgttcagtgccgcccccagcatgacggagatcatgcccttccgggcgtagccctggcagatgatgaactggttcagccccagagccagcaggttgaacaccgtcccgcagagatagacggtgaaataggtattggcgtagccgtaggtggcatcgcttgcgccgaaggccatcagcatgggctggcgcagggggaacacccccgccatcagcgccacggagcagacacacagcatcagaaagctgttggagaggatccgccgggcctcctccgttttacccgcccccatgcggatgctcatgagcggcgcgccgcccacgccgataagagaggcgaatgcgccgatcagcgtcaccaccggcccgcagacccccacgcccgcgagagcggtctcccccaccaaggggatgttgctgatgtagatgcggtccacgatgctgtacagcacgctgacgaactgggccagcatactgggtatggcgatccgcagcaccaggggccggatggcgtccgtgcccagattgttctccagcttcatagcaggtctctcccaaaacacacaaaaatcgggctgtccgcaccggacagccctctcattataaagacacgggattcagtttgcaacccccgattcgccccggaggatagcggagagctgttcgcacagtgcggcggcctgcccactgccaaaatagccgatacggaccacccggccgttgaccctggctttgccggtgccgttggagacggaaaacttccgctcaaggtccccgctggcatccagatccacgatgatgtcgccgatctccgaaataacgtctgcgactgtcagtgtatcccagcagaaatgataggtgtactgatccaacagctccaggattgcctctgcctgttcgctgtccgcagagacagtatagctctcagagtctgtctggctctgcccgtctcgcacatcgagggtgaccaaaaagccgtaaaaatcctcgccctccagatccaccgcatccccgatggagcggggccacagcatccaggctgcaaaggccaggacggccgccgccagtaggaccagtaccactcgcttcacgcttcgggccatgaaatccctcctctgcaaatagggccgccggggctcagccgcacttgcggacgctgcccagcagggtctccaaagccatcagccccaccagcacagccagcgccgccagcaggatcaacagccacttccacttgccgcggatcatctctccgccccctcggtcttgttttttccaacataacataggccatggaatttgtccataccgcgtctgaaggcaggcactcaaattccccgcaggtcaaaggccggggtgtactcctccctggccgacgtccgctcctgggtgtagccgtcggtgatcccgcagttttccatgtactccactgccgcccggtactccgccttggtcacgtggcgggccagtttcccttctgcccctggctggggcgtatactggctcatgagggaaaacagcacctccccgggcggaagctctccgccacccagtcgatgactcttcgggtgttctccagttctcccggcaacagaagatgtcggatcaacacaccctgctttaaaaggccgttttccatccggtaaggcccggtctggcggaacatctccagaatggcccgcttggcccagtcaaagtagtccgccgcgccagagtatttgcgggcaggttcggagaggccatacttcaagtccggcagatacacctgtaccttcccctccagacggcggagggtctccggtttctcatagccgccgcagttccacaccaccggcacgggccattcctcgtcccccagggcctccagaaccgcgtcggtgaagtgggtgggggtcaccaggtccaggcaggcggcctcctgtccgatcagctcgtgaaagatctcccgcagccgctccgccgtcaggacctttcccacctccccctgggagatgggcttgttctggcagaagcagcaccggagattgcagccggagaagaacacgcacccggcgccgcgctcccccaccaggcacggctcctcccagaggtggagcatggcccgggccgccacgggcacgctgggcatcccgcacacgccgccccgcctcgtctccgtccgctcctcgccgcagtttctggggcacaggcggcagatcacagcaggtcctcggggcggaagtccgggcccaggtccccggccatccagtgcttgcggcacagcccgatgtactggtcgttggcccccagcaccacctgctcaccctccttcagcaccttgccggcagcatcgaaccgggcgttgaaggtagctttcttgccgcaccagcagatggtcttgacctcctcgatcttgtcggccatcaccagcagggcctcgctgccggggaacaggtcccccttgaagtccgcccgcaggccgtagcagatgacggggatgcccaggtcatccaccagacccaccaggtacatgacctcctcccgggtcaaaaactgggcctcgtccacgatgacgcaggcgttctgctgcagttccatgacagagagctgctgcatctcgtcaaagtagatgcagggataggtgaggccgatgcgggaaaccaccatgtggtccccgtcccgggtgtccagccggggcttgaccagcagggtcttctgcccccgctcctcgtagttgaaccgggtcatcagggcgtttgcggtcttgctggaacccatggccccgtatttgaaatagagctgtgccatttgtctgttttctccctctctatgtatcttcttatgcggcactccgccgccttctctttggtgccggtcccctccgccgggagggatcctcagccctgcagcccacggtcgatcttccgctgggcctcccgccgccgctgttcctccagctgctccgccgctttctccgacgtcaggggcttggggatctcctcctccggaatttccatcaccatcctgcggcagctgcggcagagccaggcggtcttgtacctgttgaaaaggctcccctcatggaggatatcgatctccgggccgctggcaccaaagaaccggttgggccagccgggccaccactggacactgtcccgtcccccagtgatcgtccccacctccatctcctgcccgcaccaaggacagatcatgggcgggggcggggtctcccgcagggccttcttctccttccgctcctcgttccagtcccggagctcgtccatcaggctgggagcgcagtccttctcctcctgccccggctccgccggacgggacggcttttccggctcatagtcccagggatcctcgcttttcttccagaagggcacggtcactcctcctctcggctttcggataaatgctctgcatcagccccgtagatgatgcggcggttgatctcctcggaggtcagatgctccgcccgggtgcagttggccgtgtcaaggaccagcttgcggcacgccccgcagtgccaggccagcttgtaatcgctccagaaggaaccgtccccccggaggtagagggttccgtcggcatccgccaggcgaaacgcgccgggacgctcccacaccaggcggacagcgtcccttccgcccaccagataccccatccgcatctcctgcccgcaccaggggcaggtcatggcagacggcgtctgctcctccgctgtctccttctcccctgggaccttccacgcctccccgtcggcggccgggggctggggctcccccgctgtccaggtgcgccgtttctccggctccatatcccagggatcctcgcttttcctccagaagggcatcacgaatcctcctcgttttgctctctcgcctgccggatgcgttcctcaaaggtctcccccgtccgccggggcaggaaggagacgggctccggcgtctccttcccatggtaatagcaccacagccaccggaggcaccagaccagcttgcggatcagcagggccagcagggcgatgcccgccaggttgatgagttccattcagttgccctcgtccttcttctggtcctcggagtccgggacctcctcataatccaccgtatacacagggccgtgaaatttcggctcctgcctgtcctcgtcctccgcccggtaccgggcggaccgcctccgcacatgccgcaccaccaagatcaccgccacgagaatgagaatgggcaccgcaaaccgcagcgccaccagcaaaatactccccagcagccgaaacagccccaggggcagtcccaccagccagcccattcgtcactcctccttcaagcgtgctgccgcttccgtgtaataccgcccaaaggcggagggcaccgcccggtccgacagggctccggcatctgcccagacgaagtccgccgggccgtctcccgccacctccagggtgtaaccggtcatgtgccactccacatgggtaaagatgtgcttcgccgtcagtcggctctcccaccgcctgggctccaggccccagacggacaccgccgctccggcggcagcctcgtccagggctccctccacgttgggaaactcccacaggcccgccagcaacccggtccccggccgcttccgcagggcgatctttccgtcccgcaccagcaggaacaccgtcttctcctccacccggcgggctttttggcccccttcactggcagatcctctgccgtgccccgaaggcggcccttgcagaaggccatggccggacactccagacaccggggcgggccgttgggtgcgcagaccgtggcccccagctccatggtggcctgattgaagacgcggatatccgcctcagcctccggcatgacggcctggatctgtgcccgcacggccttttttaccttgggatcggcaatatcgtcccggcagtccgtcagccgcatgaccacccgcagcacgttgccgtccaccgccgcttcccgtcggccgaaggcggcggaggcaatggcgctggcggtgtagtcccccacccccggcagggccagcaggtcctggtaggtgtccggaaaccggccgccctgctccgccacgatcctggcggccttctgcaggttcctggcccggctgtaatagcccaggccctcccacagcttcatcagccgctcctccggggcggctgccaaagcctccaccgtggggaatgtctccagaaagcgggcataataccccagcaccgccgctacccgggtctgctgcagcatgatctccgagacccagatctgatacgggtctgtggtccgccgccagggcaggtcccgggcattggcccgataccacgccaacagcggccccggcaaatcttgtaaaacagttttggttgtcaaattctcaccgcacatggtatgattgtaccatatccgcagaatggatatggcaccctttccgaacttgcgccgctgtatcagcctgtccagccgcacaatcgccgcattgcggttattgtaccacatccggcgccaacttcccaccccctgtacaaaaattttgaaagtctcttgactttcccccgggtggaaggtgtaccctgtccccagagatgaggtgtaatcccttgaaaatcaatgaagtggaagccctggtgggcatcacgcggaagaacatccgcttttatgaggcggagggactgctctcccccggcggaacagccagaacggttaccgggactatggggagactgaggtggaggtcctgcggcggatcaagctgcttcggaagctgggccttccgctggaggagatccggcagatgcagcacggcgcctacaccgtgggggacggtatgcgccgccatctggtgtccctggagcgggagcggcagaatctggaagcggccatccgcttctgcgggacgctcacagaccgcagggagcggctggaggagctggacgcccagtccctgctggatcggatggcccagatggaacaggagggaacgacctttatgaacaagcagaagcaggacaccaggcgccgccgcttcgtggcgcccatcgtggtcgccatcgtcatgtcagtcctgatggcggggctgatctggctcttcctctgggctttcgaggtggatccggccggtgcgccgcccctgccggtgctggcgctctttgtggccatcccggcggcagtggtggtcggtgtggtcatcgccctggtccagcgggtccgggagattgagcggggagaggaagacgatgcgcggaactactgagcggcgggattgtcgacaagcagcggtgtccgccgcagggacggccgtatggctgctggctgcggccgcggtgttgctgtgggtgcggcaggcctttttccccagcggtgcggcatccgttctgctggcggttctggccgctgtccaggcagcagggctgatcccgctggggctggccctgcgggaccgcttgaaagagatcaaaggaggagaattatatgaagctcgtcagtattgagaccattcccggccaggaatttgaggccctggacatcgtgcggggcacggtggtgtacagcaaaaacttcggccgcgatttcatggccggtatgaagaccctggtgggcggagagatcaccggctacaccgagatgctggtggaggcccggcagatcgccaccaagcgcatggtggacgcggcagaggctctgggagccgacgcagtggtgggcctgcggtacgcctctgcctccgtgatgcaggggcggcggaggtcattgcctacggaacggctgtaaagttcaaatgatgcacgtcacctttctggaccacagcggctttctggtggagctgcccggtctcacgctgctctttgactggtggaagggggacctgccccccctgccatcaggccccctgctggtctttgccagccatcgccatccagaccactttgatccccggatttttgctctggatgacgggcagcgggatgtccgattccttcttggcaagggcatccatctgacagaccggaaccggaagaaatggggactctcggaaaaagccgccgcggactgccgggtgctttccggcggggagagcgcctctcccctgcccggcgtcaccgtggaggcactgccctccaccgacgagggcgtggcctttctggtgacggcggaaggccggacggtctttcatgccggggatctgaactggtggcactgggagggcgaggaccccgtctggaaccggaacatggaagcggacttccggcggtatgcggaacctctccggggccggaagatcgatctggccatgctgcctctggatccccgtctgggggaggacggcttccgtggcccccggtacttcctggagctggcggatatccgccgctttctgcccatgcaccagtggggaaattttaactttacaaatcaattcctgtcatgctatacttctttcacatcccgaactgtgtacgttaacagagtcggtcaagtctttacatttgaggaggaagcggacacatgaagatcgatggcaatgaacttgcaattgagcaaaacgagctggaccgggagggccgccatgcggaagccatggccatcaagcgggaatttctgaagcaggtgcgggagagcggtgaccactgcccctgcaagcaggcctgccctcaccacggcaactgctttgagtgcgtgacgctgcaccgtggtcaccgggatcacttgcccatgtgtatgtgggatatggtgaatgaacggctccataagctctcccgattgacagaggggaccctgcggtcctatgaggaggcgcaccgctgaggaagctccagaaaagcgcccgtgccaatcggcacgggcgctctcctcttcatctgtcttcaatctgcaaggatcaggcagctgccggtcacatcagggctgtggcccgttagctccgccacgaagtccgtgtcctcaccggcggcactgaccgccgcttccagcgcggggatctggtcaaccgtggtgacggcgtagactcggtccaccagcggggcgatatccgagagtaccaggccggcagtgtcgtcggcgccggaggtgatgacctccggcggcagctcaatggagacagccacaccatactcacccagagcgctgcgcagctcctccaggaacagccggatgctggccgcccggtcggcgccgttgtagtcgatcttgtccagcttccctactgtgggatagcccacatccgttagcaggatttcatcaaaaccctgttgtgccagctccgccgccagggtgcacaggtactgccgggccgccggcttgctgggatccagccagtttccgttgttcccgtcgtagaagatatagccgccggtgttcttcagtcccatgccctccacgtccgcgcgggcggcaatggggtccaggaagcagctcatccgggcgatggagtggtaactgctttccgtcacctccgccagagccgccgccgtgtcctccgccgtgctcacggtgccggccgcggcgccagtggcagcaaagtagatgtgtccggtgctgtctttcagcgtgacggcagcagcgttataggcgggagcagacatcacagaggctcccagccaggcatctttccagcccgcctgggtcagcggcgcggcggaagcagagaaggcagccagagccttcggcttctccggctcctgaatggtaatctctacgtcctctgggggcacttcctcttccgcggggggcgtctccgtcttccatggcaactccaggtggaagctgccgtccctatcgtagacgatatactcctgcagccatagaaagcccaccgccgccaggatgatgagcaccagcagcactgccagcgcgatcttccccttggaggtcctgccccggtagctccggtagcccttggtgcctcccatgtccgtcacctcttctccaggagattgcccctgcccgtcagggctggatggcgttgagcttgttcacgcgccgctcatgccggccaccctcaaagtccgtggagaggaacacctccaccatccgctccgccaggttcttgccggtgaaccccgcgccgatggccagcatattggcgtcgttgtggcggcgggtcatctccgcctccagggagtcggcacagtgggcgcagcggataccctgcaccttgttggcggcaatggagatgccgatgccggtggtgcagatgacgatgccccgatcatactcgccggaggccacagcccgggccgccgcctcgccgaagtcggggtagtcgcagctctccgtcgagtagcagccgaagtccttgtattcatggcccagcttctccagaagctggatgatgtcgcatttcagcgcgtagccgccgtgatcagaacccagagcgattttcatggtgatcgttctccttttcaaatcaagtcatcccattcggagaggaatggggctggaatggatttattatagccagttttcccctgaaaagcaaatcacaattcatgccacaccggtttcccctgccggaaggcggcaaaacggcggaatccgcaggcccgcagcagcgcctgcccctcccggacggcacagcccacaaaccccggcgtgtgggcatccgtccccagggtgacgatctcgccgcccagggagcggtacagccgcagccacttttcgtccggcagcggggtgttgccccggttggtgttgagctcgatcccgatgcccttggggatgatgaggcggaagatctccgcgatctcctcctcgaacccgtcgaagctgacatgcatcccccggttctcgttcaaataccgcaggggcagcgtcagatggcccagtacctggaatcgcccccactccgcgagcttccgcacctggcccaggtagtcggcaaggcagtcccgcgcttcctgttcatcccgcggggtaaggaaatacaggtcccggccctccatcttctccgacagggtgtggatggagccgatgagaaagtccagcggcggggcctccgccagcatggactccatccgcctgatgccccacacggcgtctcccagctccgcgcccaggcgcaacgtgatccggtcccccaccgccgtccgggcggcgcggaactccgcaatcatgggatcccagtcataggcccccggggttcggtggtgccgaaccggatgggctccacatggtctgtgaagcagatctcctggaaccccagccggatggccgcctccgccatctcctgcatggaggcggaggcgtccggtgagatgcgggagtggacgtggtagtcggctaaatacatacgtgcctcactttttgaacttcttgaagaacttcttctgctcctcgtaattgctctcgcccatggtctcggcgaacttcttcagcgcttccttctgctccttgttcagatttttgggggtttcaatgtagacggtgacatactggtcgccccgccccggccgttgatggaggggatgcccttgcccttcaggcggaaggtggtgccggactgggtgccctccggcagggtatacttcactttgccgtcgatggtggggatctccagctccgcacccagcaccgcctgggtgaaggtgatgggcgcctcgcacaggacggaggtgccctcccgccggaacagctcgtgaggccggaccgtaatggtaatcagcaggtcgcctgccgggccgccgttcttgccggcgttgccctgtccacggatggagatggtctgcccgttgtcgatgccggcgggaatgctggcctgaatggtctttttcttgcgcaccataccactgccccggcagtccttgcagggctggtggataatccgccccttgccgccgcacttggggcagggggaggaggtggcgaacacgcccatgggcgtctgccgccggacctggaccgtcccggtgccgtggcagtccgggcacacctccggcgacgtgccgggggcacagccgttgccgtggcaggtgtcgcaggtctcataccgctccacggtgactgccttctcacagccgaaggccgcctcctcgaagctgatggcgatggacatgcggatgctctcgccccgctggggggcgttgggattggtgcgccgcccgccgccgaagccgccgccgaaaaagctgccgaagatgtcccccaggtcgccgaagtcgaagctcccgtcgaatccgccgccgaagcccccggcgccgaagttggggtcaacgcccgcatggccgtactggtcgtaccgggccttcttgtccgcgtcggagaggacctcataggcctcgttgacctccttgaacttctcctccgccgtcttgtccccggattcaggtccgggtgatacttccgggccatttttttataggcctttttgatctcatcctcagaggctcccgggaaacccccaggacctcgtaataatcgcgtttctgttctgccatagaatcaccaacttttcaattaggaatggggagttaggaattaggaattgtggaatccgctcccggcggatgaattgaaatccgtccggctccgccggacacctcaattccttattcctgatttctaattcctaattcatgagagcgtgccgcgcaggcgggggtgtccccgcccgcgcggccgcatggcatctgatcacttcttgttattctcgtcatcgtcgaccaccttgtagtcggcgtcataatactggccctgctgggcgccggcgtcggggccggcctgctgctgggcgccgccctgggccccctggggattggcctgctgatacagcttctcgctgacggcgtagaaggcctgggtcaactcgtcggtagcggtcttgatggcagcggtatccgtgcctttcagaacctccttcagtttgtcgattccggcctggaccttgctcttgtcatcggcagggatcttgtcgcccatctcggagagggtcttctcgctctggtagaccatctggtcggcctggttgcggacctcgacctcctccttcagcttcttgtcctgggcagcatactgctcggcctccttgacggccttctcaatgtcctccttgctcatgttggaggaggaagtgatggtgatatgctgctccttgccggtgcccaggtccttggcggagacgttgacgatgccgttggcgtcgatgtcgaaagtcacctcgatctggggcacgccgcggcgggccggagcgatgccgtccaggtggaagcggcccagagacttgttggccgcggccatctcccgctcgccctggaggacgttgacctccacgctggtctggttgtcagcggcggtggagaagatctggctcttcttcacggggatggtggtgttccggtcgatcagcttggtgaacacgccgcccatggtctcaatgcccagggacaggggtgtgacatccagcagcagcagccccttcacgtcgccggtgaggacgcccgcctgcagggcggcgcccatggccacgcactcgtcggggttgatgcccttgaagggctcgttgccggtgaagttcttcacggcctcctgcacggcggggatccggctggagccgcccaccagcaggaccttgctcaggtcactgggcttcaggcccgcgtcggacatggcctggcgcacggggcccatggtggcgtccaccagatgggcggtcagctcgttgaacttggcccgggacagggtcacgtccaggtgcttggggccgttggcgtcggcggtgatatagggcaggttgatgttgctggtggtgacgccggagagctcgatcttggccttctcggcggcctccttcagccgctgcatagccactcggtcggtggacaggtccacgccgtcggtgcgcttgaactcgctgaccagccacttcatgatgcactcgtcgaagtcatcgccgcccaggcggttgttaccggcggtggccaggacctcgatcacgccgtcgtcgatgtccaggatggacacatcgaacgtgccgccgcccaggtcgtacaccatgatcttctggctctgttccttatccacgccgtaggccagggccgcggcggtaggttcgttgatgatgcgtttcacgtccaggccggcgatcctgccggcgtccttggtggcctggcgctgggagtcagtgaagtaggcgggaaccgtgatgaccgcctcggtgactgtgctacccagataggcctcagcgtccgccttcagcttctggaggatcatggcgctgatctcctgggggtgtagctcttgctgtcaatggtcactttataatcgctgcccatctcccgcttgatggaagagatggtgcggtccggattggtaatggcctggcgtttagccacttgacccaccatgcgctcgccggtcttggagaaagccaccacggacggggtggtccggttgccctccgcattggggatgaccacagcctcgccgccctccatgacggccacacagctatttgtcgtacctaagtcgataccgataaccttagacataatgattgcctccaatttatgatcaaataattctatctcaacaaataaaaatttgcgattgttgttttcattcacgccaggcgaatccattgcaatgatttgtcaggatatatgcctgacaaaaacacgttggctcgtgcgccttgggcgcacacgccagtggccgatgtccctggtgcgggggaaggtcgaggggggacacagtccccctctcgaattcgctcagtttgccacctgcacaatagcgtgtcggatcaccttgtcacccagcaggaaccccgcctggaacacctgggataccacgttctccccaaggttctcatcatcgatgtgcataacggcgttgtgcttttccgggtcaaatggctggccctgggcctcgatctccgtgactcccagcttcttcaggatctcctggtactggtggaagatcatctccagccccttcttgtggggagagtcctcatcgccctcagtggccacagcccgctccaggttgtcgtacaccgccaggaactccttgatggtgtccgccttggcgtcctggtagagattgtctttctccttagcggtgcgcttgcggtagttgtcgtactctgccgtcagccggacgaactgatccttcacggactccagctgccgggcggccagctccgccgcctccatctgctcccgggtcagggtgtaggtcttttcctttttcttcttgcccctggcggccttctccgccttctcatcgggcaccttctcctccgcgggggagcctcttcctgaggagcctcctgcggctcttccggcgtctcctccgccggctgcttcgtctcttcgctcattcttttgcatcctccttcgggggtaattcctgtttgccgaacagccgcgtcaatccctccgcaaagccggagagccgggcggccacggttccgtaatccattcgtgtgggtcccaccacgccgatcaggccccgcatgtcgttgccgatgtcatagctggccaccaccacactggtgtcctgcagggcctcgctgacattctccggaccgatcaggatcttcatgggcccctcgtccggcacagggagattctccttgctgtcggacaaaaagctcatcagctggtgggccttgtctgcgtcccggaactccggcagcttcagcagttggctggtgcccacggtaaacacctctttctgccccgcctcctgcagcacatccgccgcgtaggcgatggtctggctcaacagcaggaacatctggggcgtcacctgttcggacacatccatcagccgccggttcatctcgtctgcggagatcccggtgaagttgctgttcagcaggttcaccagggtgggcatctgctcggtgtccaccttcagctgcatccgcagcagctggctcttcacccggttgtcgcccatcatcatgaccacgatgcagctgtgctcatccacgggcaacagctcaaaccgccgggcggtcatctgcttcttgccggtggcggccacataggcggggtagttcatcagagaactcaccgcccggcccgcctgggagatcacccggtccagctcctccatccgcatctggagggactggttgatccgctccgtctctgcgatggagagccgctggcgctccatcagttcgttgacatacagccggtaacccttgggagagggcacccgcccggcggaggtgtggggctgttccagatagcccagctccgtcagatccgacagctcgttgcgaatggtggcggagctgacgccgcccatctccgcggcaatggccttggaacccaccggctctgcagtacggacatagtcctccaccaccactttcagtatttgctttttccggtccgtgagttccacaaaaagcacctctggtccaagctgtctcacgctggttttagcactcctttctccggagtgctaaaacgagtttaccaccacgcgccttcattgtcaacggatggatataaacaaattgtaaacaaatgccatcggatttttgaacattttccgcggctccgcaaatcaaaaaccggccgcctgccgcggccggtttttcgtctcacatggtccccctgtccgctcagtccggcctggcccccgccccctgccggggcagcatccccgtccgctgaagggccggctgcagcgcccgcagcagaagcaccagcagcaccgtctgcaccggcagcatgatgaggtttttcaccgcgctgagagacgcgctggcataccaggcctccaggctgaagcggccgttgctgttgagaatggcgatccacagcgcccccagcaccacgttctgcacattggtgaccagcttggcgcagaagatccgccagacccgcaggggcgcccggtacaggaacagagcgtaggtcagcacacccagcatagtggtcagagtatagccggggaaaaagggatagccgcctcctccagtgaggaagaagctgaggatgtcctccgcaaaggcgaacagcaggcccagcaccgggccgcagacccaggcacagacggaccgggccaggaagccccaggtgaccttggccccgccgaacagcggcaccgagggcacttgggccagcacaatgcacagggcgatcatcagggcggagaacagcagcttccgaaggtcccggacctcccgggacgcgtcccgccagtagtcggcggaaaagggatgtgcgtacataaaaaacctccttctgttttggcagtccgaaattcggagatgccgcacagaggaaggccgaaagggtccctgtatgcggcagcgggatgcgggacacacactgcggactcgcggtcctttcgtccgaagagcaactccccgtctctccagcactggatgtacacgtatgtccctactctgcctgttagatattgtccattataggactttcgcggaaaaaagcaagggtttccgccgtttttccagcacaccttgcggcaatccggtccatgtgttaagatgaccgcaacccgaataggagaggaggcgatccgcagatggttcttttgattaccggcgcctcgcacacaggcaaaaccctgctggcccagagacttcttcagacataccgctgtccctgtctctccatggatcttctgaaaatgggacttatccgaagcggcaacacccgcctcacgccggaggatgaccaggagctggagtcctatctgtggccgattgtgcgggagatcatcaaaaccgccattgaaaaccgccaggatctgatcgtggagggctgttatgtccccccacgctggagtcaggactttacgccgtcctatctccgggaaatccgcttttgctgccttgtgatgaccaaggcatatatcgagacccattttgcagacatacaaaaatatgcctgtgcggcagagcggcgcattgacgattccacctgtacgaaagagactctcctcctggataacgcgcactatcagcagatgtgcgagacctgggggtatccctgtattctgatcgatcaggcgtacgaggtggatatccccctgtgaaaaaacgatcccggccctttcggccgggatcgttttttcacttactctacgttactgggcagcgccagcggtctccgcagccttcgcggcagcggccttctccgcctgggccttcttgatggccttgtacttctccttctcctccgcggtggcgatgggaaggatggcgtcccgcgggcagaccttggtgcagagcttgcagcccacgcacttgtcgtagtcgatgacagccacgccgttcaccacatgaatggcgtccttcttgcactccttctggcacaggccgcagccgatgcaggagtgagtgcagacgctcatggcagccttgcccttgtcctggttggcgcaggccacgtggaccttcttggacacagggacctccgtgatcagatggcgggggcaggccttggcgcaggccatgcagtcggtgcacttgtccgggtccaccacggcggcgccgttgggaccgatggacatggcgccgaactggcaggcggacacgcaggagccgaagcccagacagccgaactggcactccaggggaccaccggccaccttggtggcggacaggcagtccttcacaccgacgtactcataacgcttggcggcgttggtgccgccgttgcagcggacaaaagccaccttccgctcaccggagggagcctcctggcccatgatctttgcgatggcggcagcattctccgcgccggcaggggcgcacgcattcaccggagccgtgcccgccaggatggcggcggcacagccggcgcagccggggaagccgcagccgccgcagttggcgccggccagatggctgaggatttcctcttcccgggggtccttctttacctcaaagaccttggaggctactgccaagatgaagccgaacacggcgccgaggacagccagcaccacaacggcagcaatgacatttccgatatccattttcctcttgcctcctcttaccagaccttcaaaccggagaagcccataaacgccagggccatcagaccagcggtgaccagggcgatgggaaagccctcaaacgccttgggatagtccgcaaacaccagccgctcccgaatgctggcgaacagcacgatggccagcaggaagcccaggccgccggtgatgccgtaaactacggaggagatgaagttatagttgttctgcacgttcagcagcaccacacccagtacggcgcagttggtggtaatcaggggcagatacacacccagagccgtgtacagagacggcatggatttctgtaaaaacatctccacgaactggaccagggatgcgatgaccagaatgaaggtcacggtctgcatatactccagtccaaagcgaaccaggacgaactcgttgaccgcatagcacacggcggaagccagtcccatgacgaacgtcacagcgatgcccatgcccacagcggtgtccaccttcttggaaacacccaggaaggggcagatgcctaagaactgggagaagatgaagttgtttgccagaatggcacccagcgtaattgccaggagttcatagatttgatccattatttgctctcctccttatttttcttaggtctggacagcgcccactgcatcagggcaatgaggcagcccagcaccaggaagccgccgacgggcagggtcagcatgccgatggggaactgctccggcaggatctgaataccatcgccgccgttgaggataccgccgccgaaggtgccggcgcccagaaactcacggatgatgcacataaccatcagcaccacagtgtagccaaagccctggaagataccgtcccagaaggaagcggccacaccgttcttgtaggagaaggactccgcccggcccaggatgatgcagttcaccacgatcagggggatgaacacgcccagcgactcggacagggccggaacgaatgcctggatcagcagatccacgcaggtcacgaagccagcgatcaccacaatgaacatggcgatacggatcttgtccggcacgatcttgcggatagccgcgatgatgacattggaaagggtcaggatgacggtgaccgccacgcccatgcccaggccgttgaagaacgaggtggtgatggccatggtggaacacatgcccagcacctgcaccagcacagggttgttggtgatcagtccctctttgaactgtttgcctaaattcatgaattgctcctcccttctcagcccatggcagccacggcagccagcgccgcattcacgccggcagtcacacccttggtggagacggtggcgccggtgatggcgtccacgttagtgcccaccgtcagagtgccgtccgccgcgctcttgccgataaactggtccagcacacccacgccggaggcggtgggttcgttgcccacgaccttcgtgccgatgccggaggtctcagagtggttgacgacagaaacgccagtgacggcgccttccgcgtccacgcccaccatcatttcaatgctgccctgggagccggaggcggtgacctttacggcatagccggcggcctcgccgttcacctggacctcgtacatctcgttcagggtgccgccggcagctgtggccgcagcggtcatgtcgccagacagttccagcgcgtcggagaaggtggtgttgtccggatcggacaccacggccagcatggccgcttcagtcttctgctggttgatctcagcgatggggccggccgtcacaccgttgaccagacccagcagcagtgccacgatcaggcaggtccccagcagggtcacagtcagctttacgatgtacttggggtccatatcaatcttttctttggtcttgacttcgttgctcatttcgcagccgcctccttgttagcggatttcacaacgccgaagcgagagggcttcacagccttgtcgatcagcgccactaccaggttcataatcatgatggagtagcacacgccctcgggataggagccgaagtagcggatgaacaccgtcagcaggccgcagcccaggccgaagatcagctggccggtcttggtgacgggggaggtggtgtagtcagtggccatgaagaaggcacccagcatcaggccgccgccgaagatgctgtacagcatgaactgcagattgtcggcgccgcccttggggaacaggaaggtcagcacggccacggtggcgatgtaggccgcgggggtctgccagctgatgaccttgcgccagatcagatacgctccgcccacgatcagcagcagggcggagatctcgcccagggagccgccgatattgcccaggaacatatccgtcacgctgtactggctggtgaggccggccatgtcgccggtcttcatataggccagaggcgtggcagcggtaaccacgtcggcagtgccggccaggggcacccagccggcctggggatccgcccaggcgccgctcatggtgccggcatagctggccaccagggcggcacggcccgccagcgcggggttgacgaagttcttgccgatgccgccgaacagctgcttgaccaccacgatggcgaagaagtcgcccaccaggatcatccagtagggcatgttcaccgggcacacgaacgccagcaggatgccggtaaccgcggcggagagatcgttcacggactggggcttcttcatgagcttgcgatagccccactcaaagaacatgcagcccaccacggacacggcagtcagagtcagggcccggaagccgaacttcacaatggcccagatcagggcgggcatcatggcgatgataacatccagcatgatggagcgggtgttctccgccgcccggatgtggggagaagaagtggcaatcagtttgagattcttgtagtcagtcatttcgcagcggcctcctttgcttcttcggcctttttctttgcctcggcggcagcccggtcagcggccgccttgtccttcaccagctgcttgccggttttgaacatatgggtcaggtgcatccgggccgggcagatgtaggagcaggcgccgcactccatgcagtccatgatgtgggcgtcattcagctcctccaccatgcccttggaggcatactggtacatgaacaggggctccaggtgcatcgggcagacggacacgcacttgccgcagcggatgcactggggattctccacggtcttctcctcgttctcgcagaaggccaggatggcgccggtgcccttggccacggagatgtccgcggtgtactgggccatgcccatcatggggccgccggcgatcagtttgtatgtaccgtccttcaggccgccgcaggcgtccaacaggctggagacgggggtgccgatggggcactccaagttcttgggctccaccacgccggagccggagacggtgacgatcttgcgcaccacgggcataccggtggtcagggcccggtagatggcgcatgtggtgttgatgttgaatacggcgcagccgatatcggcgggcagtccgccgggggcacctggcggccggtgatggcctggcagagctgtttctcaccgccctgggggtagcggcagcgcaggggctccaccaccacgggggccttctgctcggcaatgaccttgttcatggcgtcgatgccgttgcgcttgttgtcctccacgccgatgacgaccttgtccacgccgaacatcttggccaggaacttggcgccgccaatgatctcctcgggccgctccagcatggtgcggtggtcgcccgtgatgtagggctcgcactccgcgccattgatgatgacggtgttcaccttgccgatgccgctggtgatcttcacgtgggtggggaacgtagcgccgcccatgccgacgatgccggcgttcttgacgatctccaccatctcctccacgctgagggcattgggatccgcgggggcctggacctcttcgctcacctcgtcctgcatgtcgttttcaatgaccacagacgtgatgttgccgcccatggaataggggcggggttccactgccttcaccgtgccggaaacgctggcgtggatcggggcgcccaatccgtggaattcgccgatcttctggcccaccttcacgtggtccccggccttgaccaggggcgtgcagggcgcgccaaagtgcatcgacatggggatgaccacaacagccggcggagccagctgctcgatggccttttcattggttgcggccttcatatcatggggatgaacgccgccaaagaaagcttgtgccattgtcttcacctcatttttactccttgatagtcggcccgggcaggagggcacggcccctccccttcccaagagagggggtctccaggcaggcgacactatcacatactgcgcctcattctacacctatttttgaaaaatgtccagactgtgaacgacaacttttgaaaaaaatatgcttctttatacagaatctttgcaacttttcacacgttttatccagttctgtcattccctcccatttttacgccgtctcttgttatttcagaagaaacatgatatgcttggtgatacgggtccggctccggccgccccattttcaaattatctggaggccaagacatattatgatggcacaactgatcgaccgaaagcatctgaagcaggagatgaaggagctgctgcgctccgcccaggtcagcccccgcgggatgacctgcctgtacctggccctggtgctggtgctgaacctggcggacagcttcatgggtcttatgaatccgggcctgctgggcaccttcatctccatcctcaccggcctgatgagcatggtcctggcctccggcttcgtgatgtactgcatggccatccgccggggcgagcgggcggaatacctgacgctgttcgacgggttctcctttgtgggcaaggtcatcctgctgaacatcgtgatctacctcttcacgttcttctggtcactgctgttcgtcattccaggcatcatcgccgcctaccgctaccgcttcgccctgtacaacctctatgagaaccccggcatcggggtgatggaggccctgaacatgagcaagcagcagactcttggctacaaggggcagctgttcatgctggatctgagctatatcggctggctcctcctggcgtccctcacctccgtcgtgcagacgggctatatctacgcctgcattttccaggaccccggctactatttggcgaaccccgcccaggtctatgccatcaccctgcccatgcccgtaggattgcaggtggtgctgggctgtgtctggccgctgctggtggcgttgttctacctaccggtctaccagtgcacggagcttggctattttgacaccgccaagcacacttccggcgtgggagagggcgcggcccccaaggatcccggcagctttgacagcggctggggaggcttctgagcgccccattaagcctacaagcccccggcgggttttagaacccgctgggggcctctctttcaggagacctcgcctgcgggccgggccgggggctctgcgccatccggcctccttccggggtccgcctccgcgccaagggccccctccacaagcatctttcagattctccctcagacgcaaagctcccccggcgggccaaaggcccgccgggggagctttcttccatgttgcggggatcacagccgggggaactcccgccggacgtaggcgctgcggcccagagccgccgccagcagtgtggaggcggcgatgccgaaggcagcctgcaccagattgctggggatacctgccgcggcaccagccgcgctccccagcagcagggcgtcgtacagccagtagcccaccaccatgggcagctctcccatgatgccgcaggccgcaaggcccaggggaccccgtccctttccgaacgcctgatggcacgcggccgccaaagccgccatccctgccttgatgaccagggtagcgggtgcgtagatgggcgagcccagcagcacatccgccagggccgggccgatgctgcccgccagggcgccccaggctggccccagcagatatccgcccagcagcaccaccgtgtcccccaggttcatgtagccgccggtgggggacggcaccttcaccaccatagtggccacgcaggccagcgccgcaaaggccgccgccatcacgaccatccgtgtccgctggaaggtcttggccgtctcctgctccgctgtcttctccatatcctcttctccttccggcggggccgtctcgcgccccatttgctgttgccatcatagaacaaatatgatatgattaaaagcgtcaatttctgaattttttatcaggtcagatggaggaagcccatgcgtacctacgccctggaaaaccgcggcagagcgccgctgtatgaatacctgtaccgctgcatccggggggacatcctggacggcaccctgacggccggggagcggctgccctccaagcgggccctggcggagcacctgcacatctccgtcatgacggtggagggggcctaccagcagctggaggcggagggctatgtgtacacccagcccaaacggggcttttttgtggcggaggtggagcggccccggcctgccgtccccgctcctccggctcctgaggcgccgccggaggccccggtctggcggctggatctgaagagcaaccaggtggacgccagccgcttccccgcggcggcctgggcccgtctgacccggcaggtgctgtccgaggacggggaagccctgctgcgcccagtgccccaccaggggctgcccgccctgcggcaggccatcgcccgggacctgcgggagtataagggcatggctgtgccgccggagcagatcgtggtgggggccggggcggagtacctgtatctgctgctggctcagctgctgggacgggaggccgtctttgccgtggaggatccgggctatcccaaaatccgccaggtgtacggcaagtgcggcgcggcttgccgcccggtgcccctggacggccagggcgttcccccggaggccctggaggcggcgggagccagtgtggtccatctctctcccgcccaccactatcccaccggactggtgacacccatcggccggcggcaggccctgctccgctgggctgagaaggctggaggcatcatcatcgaggatgactatgacagcgagttccgctttacaggccgtcccattcccaccctccagagtatcgacaccgccgggcgggtggtatacatgaacaccttctcccagaccatctccccctccatgcgggtgggattcatggtgctgccgccccgcctgctggagcagtaccgccgggagctggatttttattcctgcacggtgcccgccctggaccagcacgtgctggcccggttcctggaccagggccactacgagcagcacctggctcggatgcgcaaggagtaccgcacccgtcacgacgcggttctggcctccttccggtccagccccttccggaaccggatcacgatctcggagcagggggcggggctccactttctcctgcggctggacacccgggagagcgacggggccctgcgggaccgggctgcggccctgggcgtccggctgggctttctctcggagtacgccgccatcccctcccctgcctacgcccacacgctggtggtgaactatgccggcctcagcccggcggcgctgccagaggccatggacctgctggcggagatcttcggggcctgatgcctgccgtccactcccccgcgcaaaaaagccggccgccccaagggcggccggctctctgcatcgggttttcagttcacacgccgggctttccctccagcgcggtcatgctctttttgaaatggacagcgaacatggtggctgtggtacacaccgccaggaaatccgccaccggctccgccagaaagaccgcaaaagccttatccgcaaaaaagttgggcagaatataaatgaagggaatcagcaggatgatcttccgcagcactgccaggaacaaggagatcttggcgttgcccagggccacgaaagtctgctgacaggcgatctggatgccgaagatcccggtggccgccatgtagatccgcagggcccaggaggcatagctcaccagctcgctgtccgaggtgaacatcagggcgaacagctgggggaacagctgcaccagcgcccacagcagcagggagtaggccaggcaggccatcagcagcacctggaaggcacgccgtacccgccccggattccgggcgccgtagttgtagctgatgatgggctgggccccttgggtcaggccctggaggggcatcatggcgaactgcatgatgctggagagcacggtcatagcacccacagcgatgtccccgccgtatttcagcagtgaggagttgaagcacacggtaatgaggctctccgtagactgcatgatgaagggggaagcgcccagggccagggccggcagcaccaccttggcttggggccgcaggtgctcccgccgcaggtgccacttggtcttgctgcccgtaaggaacttcagcacccacaccgcggagaccgcttgggatagaatggtggccaaggccgcgccccggacccccatgccgaaggcgaagatgaagatggggtccagcaccgtattgaggatcgcgccgatcagcacagtcttcatgcccaccaccgtgaagccctgggcggtgatataggcgttcatgcccagggtcacctggacgaagatggtgcccagggcataaatgcgcatatagttcagggcgtagccgatggtgttgtcgctggcgccgaagatgcggagcatgggctccgcaaacaccagaaagaccacagtcagcaccacggacaccgccaccagcatggtgaagctgttgcccatgatccgctccgactctttcaggtctccccgcccttcggcgatggaggcccggggtgcgccgccgaaggccatcagggccgcgaaggcggagatcaccatgatgatgggcaggcacacccccacgccggtgagggccagcttgcccacagtctccaccggctgcatgtggccgatgtacacccggtccaccagattgtacagcatgttgacgatctgggaggtgatggtaggaacggccagggaaaacagcagctttcccacgctcccgctgcccaggtccacatttcgacggctcatgtattgcctccttccttcaaccgcacttccgcgctggtcagaaccttttccagcagttcctgaaatcgctccgcctccgactgtgtcagaccggcaaacagcgcgtccaggcaggtactctggagcttctgcccctcccgggccagggccgcgcccgcatctgtcagcgccagatggatcacccggcggtctgccttgtccggctgacggcggagcagctcccgcgccgccagcaggtccaccgcggcggacacctggctcttggccagtccccggagctctgtcacgtcccgggcagtgtcatgtgccggatgattggccagaaacagcaccacatgaatctcccgcatggagagcccggtgcgggacagaagctctgagaaatgcctatcgtaataccggcggaactgctggataacccgcagcagctgcgtactgctcactgccacagcgcccgccccctttcattttatttaaaacagttcttataagaactgttccagcatagcactattttttccgcctgtcaagatttccgaatccatccttgacaattctcccttcctccagtatgatggtggcagaagatatcgtttttaaaatcagatttcggggtgttctttatgacatggaatattgtgagcgacagcagctgcgacctgcggacagcttccttccacagcagctgcgtccggtttgagaccgtgcctctgcgcatccaggtgggcggccgggaatttgtggacgatgacgccctgtcggttcccgccctgctctccgccatggcggtggagaaggctgcctcctcgtccgcctgcccctcccccgccgactttgccggggcctttgagcggggggaccgtaccgtctgcttcacgctttcctcccagctctccggcacgtatcacgcggcctgcatcgcccgggagatggtgctggaggagcacccggaaaagcagatctgcgtcatcgactcccgcgccgccgccgggaccatggtgctgctgatccgccgggcccaggccctgatggaggcagcgggggatgatggggacttcgacgctctctgccagcagctccaccgctatcaggccaccctgcggacctgcttcaccctggagaatttcgacaaccttatcaaaaatggccggatgcggcccattgtgggcacgttgctccgctccctgggcatccacatcattgcggacgccacagccgagggcaccattcatgtggcggataaggcccggggcgtgggtaagacctaccgggccatcaccgccctgatgaaggccagcaaggactgcaccgacgcagaggtggtaatctcccactgtgagaacctggagggtgctatggccctgaagcggcagatcctggcagacctgccggtgaaacaggtggacctgctgtcctgccggggactcaccagcttctatgccatggaaaagggcctcatcgtggggtactgaggtacgtccttccccatcaggcgcctccgcggaaggccgcttccggaacagcagtcagccgccggaaccgccatcttccggcatttggatatggcaaaaaagcgcgcacggaaaaccgtgcgcgctttgctttttctatcccagcagcacacccgccaccaggaacgccagggccagcagcaaaaaccagagtatcagcttccacacatacttcacccagcggtcgtagggcacatggcccagggccagggcgcccatcaccaccgccgcagtaggggtgatgatgttcaccaggccggaggcggactggaacgctgtcaccaccagatcgccgcccaccccggcgaatttgcccaggggcgccacaatggggatggacagtgtcgccaggcccgacgaggacgggatcaggatggtgaggggcaggtacagggcgaacaccagcagcgtgaagctgatggccccggcgccggaaagggcctgctctccccagtggaggaccgtgtcggtgatggcgccgtcgttcatcagcacagtgatgccccggctgatgccgatgataaaggccacgcctaaaaggtccgcgcagccggccacgtaggtctctaccagctcctcctcactcatccggtcaatgaggccgatgacgacacctgccaccaagaacagggcggagagctccggaaaccaccagcccagagcgggcagggacaggcccatctcgtcaaagggcaccacagcatagaccatgatgaggaatgtcagcgtaaagagggccatgatgaccttccgcttggcggtaaagggcacctgctggtccatgcttacctggatcttgcccgcgcccacgcccaccacggatttggaggggttcttcttgaccttcgcggcgtaggccatcacaaaccagatggccgccgcctcaaaggccacccactccagcagccgcagcacgataccctctcccagagagaccccggcaaagcccgcggcgatgccggtggcaaaggggtttaccgtggaggcgatgacgccggccccggcccccagcaggatcacgctgatgcccactaccgcgtcgtacccggccgccaggaacaccgggatcagcaggggataaaaggccatggtctcctcccacatgccgtaggtggtgccgcccaagccgaacagcagcatcagaatggggatcagccacttctcccggccgcccagcaggcggatgacgttgcccacgccggcgtccacggcaccggtcttcatcaccacgcccagaaagccgcccaccatcaggatgaagatgcacacgtccaccgcgtcgtaaaagccagaaaaagctgccttcagaacgtcgcccactccctggggattctgctccaccgtgtggtacgtccccgccaccggcacgccgtccacgtagtcatagctgcccgccgggatgatccaggtggcggcagccaccaggatcagcagcaggaacaggatcgtataggctgtgggcatgtggaattttttttgattcaagatatctaccccgcttctgttttgacgccgcggcgtcaacatcatttccatcatgtttgccggcagcacgcgtgtcggcaaacatccttcccagctatcaagtgtgcaagcgaagcgagtacatgcagatagctgtaaacgctctcacgaaaaaggcggcgccttttccatgaattatcttccgatggtggccaccagcacagctttgatggagtgcatccggttctccgcctcgtcgaataccacactgtggcggctgcggaacacctcgtcggtgacctcccggatgtccacgcccttgtcctgccactccttggccagcttggtctcaaagtcatggaaggagggcaggcagtgcagatacagcacgttggagttgccggtggccttcagtgtctcctccgtcacccggtagggagtcagcagcttggcccgctcggggatcaggtcctcctcgcccatggaagcccagatgtcgccgtagatcacgtccgcatccttcagggagttcatgttgtcggtgatctcgatgaggccgccgttctcccgtgcggtggcgaatacccgcttcaccagtgtgccgtccatctccttggccagctcctggggccccaggcccacaaaatgcatacccatcttggcggcgccgatcatccaggcgtagcacatattgttccgcacgtcgccggggaacaccaccttcacctggttcaggggcttgtggcagtgctcctcaatggtcatcatgtccgccaggatctgggtggggtggtctgcgtcggtgagaccgttccagacgggcacaccggcgtacttcgccagatcctccaccaccttctggtcgtagccccggtactcgatgccgtcgaaaaaccggcccagcactttggcggtgtcctccagagactccttcttgcccatctggctgctgccggcgtccagataggtgacgtggcccccctcctgggtagcagccacctcgaaggagcagcgggtgcgggtggaggtcttttcaaacagcagcacgatgtgcttgccctgaagggttgggtcgcagatgccggcccggcgcttggccttcaggtcgtggcccaggtccaggagataacggatctccgcgggggtgaagtcttccagagtcagaaaactccggcctttcaaattgattgccataaaatgcactcctttttatcttgttcatgatgaggactttttgaggggacagatgtggaccgccgaacaggggctgtgggggatactgctcccggcggaaaagaaaacatgtttcggcgggggaaggttggcgatcccttgcggcggtcagagagggaaacgtccggcccttgtgaacccctccagcccggggaagtccgggatacacgctgcgctgattttcgctgccgctggccggtggttaatgagagtttcagcatagggccaagctgcagcttctatgaccgccagggcagtgcgtagcgaagccgaacgcgcggaaggaggaaccagtggaacactgatgacggaaatccccggagcgccgtagcgcgagacaggaaaagcgaagcagttcaaatgcgtccttgcatcccggcaacttccgcaccatccgccacgggacggcagtcgagggaattgcagaagggcctagcgtgcccgaaggcaaggccaaatcggagcaggcaccgattcgccgcccccccttcagcgcggagggccactgcaccagagcgcatccaggcgcctttctctttggaccgtgcacggcccgtttctcttttggcaagaccgataaggggtcccgccgcgccccgcacggtggggagaggaggagcgcccaagcccacggagtgggcgcggaagtgcccttggggtgcaagggagcgggcgcagttttcgccgtacacggaaacggggctgagcggactttgcgacgacgacatgggggtgcatcccgctggacaagccctccctggccggggcggcccattcacgctccgcgaatgcttacggatcctcccgccacagcggcatggacatgcaccggggtccgccccgcccgcgggagagttctgcgctgggaatggtgtggagccggatgcccgcctcctccagggcccggttggtgacatagttccgggagtacaccaccacctcgccggggccgatggccagggtattggagccgtcgctccactgctcccgggcggcgtcgatctcgctgccctggccgcaggggatcagtgtcaccttatccagctccaggtgctccttcaggatgtcctccagccggccgtcctcctgacggattttcatcttccggttttcgtccagctccatgacgaacaccgtaatctgctggaggatgttgggatggacggtgaacttgtcccggtccaccatggtgaacaccgtatccaggtgcatgaaggaccggctcttgggaatgtcaaaggccagcagcttgcggaaggtcttgctctcggagagcaccgtctccgccaaggcgtcgatggagtcctcctccgtccgctgagagatgcccaccgccaacacctgaggggacaggatcaggatatcgcccccctccagggaggaggtctcgccccggtcgtaccacctgggggcgttgcggtagtccgggtggtgctcgaaaatgaacttgccgaacagggtctcccggtttctcgtggcggtgtgcattttgtggatggacacgccggtaccgatggtggcgaaggggtcccgggtaaaatagaggttgggcaggggatctacggcgaaggggtaatcatccccggcggcagagagatagtcccccagccgggcgctgtttgcccggagctgggacttgcggacgcccgccatcatggcagacaccatctccttgtccggcagggcagagaggaagtcctccaggctctcccggagccggtcgtccttgacgccggactcctccaggaactggcggatcaagtcggcccgcacgtcggcgtccgtgatggactccgccaccagatcccgcaggtagaccacctccactccttgctgccggaggcagtcggcaaaggcgtcgtgctcccgctgggcctccttcagataggggatgtcatcaaagagcagccgctccaaatactccggcatcagattttccagctcaccgccagggcggtggagaaggacctttttcagccgcccgatctcggaggtattgtgaattccggtttccaaaaagctcactcctttgttcatcggaaaggtacagggaaatcgctctggtttagggtctctggattttggcatttcatgcgccgttccgaaaaatccgcgcaaaaaaagaacggacgaatcgtccgttctccccacatgttctccgcaaaggccgcccgtccctccttcgggccgcggcgtctccccgccgcctccggggtcccgcggcatcggcagtggaaacgcaaaaacaggagagaggcttccgcctctctcctgctgttatctgtgcttgccgagatacgcctctttgatcttctcattggccagcagctccgcgccggtgccggacatggtgatgttccccgtctccagcacataggccaggtccgcgatcttcaaggccatgttggcgttctgttcgatcagcagtaccgtcacgccctggcggttgatctcccggatgatggagaagatgtcctgcaccaccagcggcgccaggcccagggacggctcatccagcatcatcagcttcggccgtgacatcagggcccggcccaccgccagcatctgctgttcgccgccggagagggtgccggcggactgccagttccgttcctccagccgggggaacagctcatagacccatttcaggtccttttcgatctccgctttgtccttgcggaggtaggctcccagcttcaggttctccagcaccgtcaggtccgcaaacacccgccgcccctccgggctcatggcgatgcccgcggagatgatcttgtcgatgggcttgcccagcagctcctccccgttccactggatggagccggactccgccttcaccaggccggagatggtccgcagggtggtggacttgcccgcgccgttggcgccgatcagggtgacgatcttgccgtccggcacctccaggtcgatgccccggagagcctggatgccgccgtaggacacccgcagctgttggattttaagcatcttccgccacccccaggtacgcgtcgatgacgcgctgattgttctggatctccgccggtgtgccgtcggcaatcagcttgccgaagtccagcacatagatccggtcggagatgtccatgaccaggtccatgtggtgctcgatcagaaacaccgtcaggccgaacttcgtgcggatctccccgatgaaggccgtcagctcgtcggtctcctgggggttcatgcccgcagccggttcgtccagcagcagcagctgcggatccgtggccagggcccgggcgatctccagccgccgctgcttgccgtagggcagggagttcgccttctccccggaaacgtcgctgaggttcacctccgccagcagctcttccacccgctggcgctgccgcgcctcctcctgccggttcagatggaaggtcgcagtgaggagattgcacgtcgcacggcagtgcatggccgtcagcacgttgtcgaacaccgtctggtccttccacagacggatattctggaaggtccgggccatgcccatccgggtaatcttgtccggggtgggggccagggcgtgggtgtactccccggcgtgctcgcccttgtagagcttgcgcatcttgccctgggggtagttttccacgatcttctcccccggtaccacaccgcgccgttggtgggctggtacacgccggtgatgacgttgaaggccgtagtcttgcccgcgccgttggggccgatcagggagacgatctccccctcgcctacctccagattcatgttgttcacggcgatgacgccgccgaactgcatggtgatattctccaaacgaaggatcttctcactcatttcgccgcctccttctttttcgattttccggagaggcgggcccgcaggctccgggccacatcagagagctcccggtcccccatgaggccgcggcggaagaacagcaccacgatcatgatgatgatggagaacaccaccatccggaagccggtccgcaggaagggcaccttgaaggcgccgatatacgtctccgtgtccaggaaccgcagccaccactcgctggccgccacgtacaggaacgaggcgatgcagctgccggagatggacccgatgccgccgatcaccacgatcagcaggatctcgtaggtcatggaggtggtgaaggtcttggcttgggcctggttggcgaacatggcgaacaggccgccgcccacgccggcgaagaaggagctgatgcagaaggccatccgcttgtgcttggccaggttgatgcccatggcctcggcggccacctcatcctcccggatggccttgaaggcccggccataggtggagttgatcaacaacaccatgatcccgatgcacactgccaccagcaggaagggcacaaaggtggaaaggcgcagcaccacctccccattggcgttctcgatgttgaagctggagaaggtgggaaagctcttcagcgcgttggcgccgttggtgacagggcccagccggtcccactggaagatggcccggatgatctccgcaaagcccagggtggcgatggccaggtagtcgctcttcagccgcagcaccggcaggccgataagccaggcgatcaccgccgccacacagcccgccaggatcagcgccgccagcacacccaggatcagacccagggcgccgccgccgaacagctccggcagggagaaattcactgccgagccgccgtagaggtagtagacgctctcccggtcggcagagggaatggtcagaatggcgtaggtgtaggcgcccagcagcatgaagcccgcctgccccagggagaacaggcccgtaaagccgttcagcaggttcagggaggccgccaccagcgcgtacacagcccccttcttcagcacggtgaacagcatactggtgggctgcatggtgttctccagcacaatcaccaggaccagcagggccgccacgcagcccagggcgatccacgcgccccgtttgctctttttttcttgcagcatcgtgacgccccctttacactttgtcggtggacttctcaccgaacaggccggtgggcttcaccaccaggatgatgatgagcagcgcgaaggtgaacgcgtcggaaaacacactccagttggagctcttgatcaccgtctcgctgagaccgatgaggaatgcccccaccacggccccgggaatggagccgatgccgccgaacactgccgccacgaaggcccgcaggcccggcagggagccggacagcggcacgatggagggatagttggtgaagtacagcgcagaccccaccgccgccaggaaggaaccgatgacaaaggtgaagctgatgatgttgttgatcttgatgcccatcagctgcgcggtctcaaaatcccgggaggcggcccgcatggccatgccgatcttggtgtggttgatgagctgggtcagcaccactaccagcgccaccaccaggaatggcgtaatcaccgtcaccattttggtggaggtgccggcaatggtgatctgactggacaggccgggcaggctggggtacatctgcggcagtccgccggtgatataggtggccaaattctgcagcagatagctgacgccgatggcggagatcatgacgctcatccggggcgcgctgcgcagcggcttgtaggctgcccgttcgatgacaaagcccagcagcaccgtcagcaggatcatcagcggcagcgccacgccgatgggcaggcttgcgctgagatagaccatgattaatcccgccgccatgaacacgtcgccgtgggcgaagttgatcaggcgcaggatgccgtaaaccatggtgtatccgatggcgatcagggcgtactgcccgcccagcgagatgccggagagcaggatggaaattccgtattgcacagggatacccccttttctttcagagttggcgagcgggaaggaccgtctccaaaaaggccgggctgcggcccctttcgaggcggtcccatctcgcgcaagaacaagccgcctggcgggggataccccgccaggctggccggatggcaggcttattccacagtctggaccgtctccagcgtccaggcgttgttggcggtgtctgcggtcttgatataggcggtgtcccggatggcgtcgccctgctcgtcaaaggcgatggagccggacacgccggtgtaggtcacgtcaggcagcgcggccttcacggcggccttgtcggtagagccggcggccttcagggcctccagcgccacatagtaggcgtcatagcccatggcagtgacagcggcgatggtatcgttgccgccgttgttggtcatggcggtggagtcctcgttcagccatgccttgatgccgtcatcgaacttgggagagccgccctcctggtagaaggtggacacgtacagctgtacgttgctgccctgcgcggcctccagcaccacgttgctgtccagtgtgtcggagcccagcagggggatatccaggcccatggaggcggccagacccacgatctgcgtggcgtaggcgatggagacggggcagaagatcacatccacatcctctgccacggccttgttcaggtaggtggtgaagtcggaggtgttggtggggaaggagtccttgatgacctcaccgtcaaagttctgctcgaagaaggcgatcaggccctggtcgtactcgttgcccaactcacccaggcagtaggccttctgtgcgctgaacttgtcttttgcgaaattcaccagcacctgggcctggaagttgtccaggaagcaaatccggaagtaatagtcgttgcctgcggtgatattggggttggtgcaggtgacgccgatggcggccaggcccgcctcgtcaaacaccggaccgccggccatagccacgctggaaccgtaggaacccagcaccaggctgacatccttgctcaccagctccgccgcggcggtgggcgccttgtcggtagtggaaccgttgtccgcgtagaccagctccacgttgtaggtggtgccaccgatgtccaccgtgggggtctccttattggcatactgcatacccagcatctcctgcttgccgccgggaccggagtcgccggtggcgggctcgaacacaccgatgcggaccacattcccccgctgctgccggagtcgccggtggatgtgtcgccgctgccgccgcaggcggccagactcagagccatgaccatagccagagccagtgcaagaactctcttcatgcttcttttcctcctatcaatggttaaggatcgctgttccctcatgtatgaaaggcattttacaggttttttccaggctttgcaagatgaataatccacagaaagttttccgctctctttcaaaaaagttcaagatttttccgcatattccggtcatttgtccctctgttgtggacgtttcaaaaaaatcgcagagaaaaatgcggtcatttgtcctcgatagagagacaggcgaattggtaattttgccaaactccagtgactgcgttgatgcattttcccgtcactccaacagttttggagggttgcggcggctttattccccgctttttgtaaaaaggccgccgtccggttctccggacggcggccttttctcagacctcttcttttttcagggacaacggctgttcgccgaacacggccagaaacgcctcccgctccatggtctcatgctccagcagataggacgccacggcctccagcttgtcgcggttgtcgttcaggatccgttcgcagcggtcataggcatccgccaccaggcgctggacctcctggtcgatctgggcggccaccgcctcggaatagctgcggccctgggtcatggtgcggccgatgaacacctcgtcgtggccggactcgaaggctacggtgccgatcttgtcgctcatgccataggtggccaccatcttccgggcgatctggctggcccgctggatgtcgttgctggcaccggtggagatgtctcccaggcacagcttctccgccacccggccgcccaagagacccacgatctgatcctccatataccgccgggagagataggaccggtcctcctccggcagggagatggtcatgccgcccgcctggccccggggcacgatggtgatctgggccaccgggtcctgatctggcagagcgtgcatcaccacagcgtggcccgcctcgtgataggcggtcagctcacgctcgtgctgggggatcacccggcttttcttctccggtccggcgatgaccttgatctccgcgtccttcagatcctgcatggtgatgaacttctgatttttccgggcggccagcagggctccctcgttgatgaggttctccaggtccgcgccggtgaaacccggagtgccccgggccagctggcccaggtccacatcctccgccaggggcttgcccttggcgtggacctccaggatctccttccggccccggatgtcgggcaggcccacgtacacctgccggtcgaaccgaccgggccgcagcaacgccgggtccagcacatccgcccggttggtggccgccaggaccaccacaccttcgttagcggtaaagccgtccatctccaccagcagctgattcagggtctgctcccgctcgtcatggccgccgcccaggcccgtgccccgctggcggcccacagcgtcgatctcgtcaataaacacgatagccggggcgttcttcttggcctgctcgaacaggtcccggacgcggctggcgcccacgcccacgtacagctccacgaaatcggagccggagatggacaggaagcccacgccggcctcccctgccacggccttggccagcagggtcttgccggtgccgggagggcccaccagcagcacgcccttgggaatccgggcccccagagacaggtacttcttggggtccttcaggaactccacgatctcccggagctcctccttctcctcatcggcgccggccacgtcgtcgaaagtgacctttttgtccttgtccgtcagcatccgggtccgggcggagccgaatttggccatcttgtccggtcccatgccacctccctggggccgaatcaccaggaagtaccacatcagccccaggatcaccgccgtcagcaggaagggcagcagctccagcagccagttggtgcgcaccggctccgggtaatcatagtgctggatgataccctccgcatactgctgttgaaccaggtcattgaagtcgtcataaaacagctggaagctgtacagctcataccgcacggtctcgctgccgttcaccggctcccgcagctccagggtcagtgtgccgccgctgtcaatggtcagccccgtcactttttcctgcaggaacagctggcggacctgggagtattccagctggtccacatggttgtcgttctgccagagccagttgacacacagcaggatcacgagggccagcagtacgaagctcagattggatagccgtctttgttttgtcacgagcagaagcctcctttcccattgcctgggacgcaatgggagactgttttcatgttacgattgggcggagtccgcccaaaacagggcgtatcgcctcactccccggagtatacctccggcttcaaaaccccgatgtacggcacgttccggtactgctggcagtagtccagcccataccccaccacaaactcgtccggcaccacgaaccccgccaggtcggcggtgatggccttagtccggcgggagggcttgtccagcagcgtcacgatggtaatggaagccgctcccttggtcatgaagtagtccttcaaaaacgccaaggtgttgccggagtccagaatgtcctccacgatgatcaggtgccgtccggtgatgtcctgctgcaggtcgtgggtgatctgcacccggccggaggacacagtggcgttctggtaggagctgacggcgatgaactccacgtcgctcttcacctggcaagcccggaccaggtccgccatgaatacgaaagaccccttcaacacgcccagaaacagcgggttcttgccatgaaactgctcatacagctccgcgcccatttcggtgatgcgggccttcagctcctcctctgtcaccaggaccttcaggatatccctttccatctcgcttttcatatcaaatctctctcctttgccgcttcggtaatctgaatgaaccggcagggctccccctccggtgctgcaaacgccatatccacgcccagccgccacaccgccgccaggcatcctcccgcgtagacggccggcagccggtcccgctccgagagggagatccggcggtccatgcacagccgtttgatgctgcggccgcccccgtgggtctccggcagaaccagacggtctcccggcgccgcagggcccaccgtcaggcccatccgctccccctgccgccagggccgaagggcaagtccctccccctcccggtgatccagcagggtgatccggtaatcgccccaggcgacggggcactcctgcaacagctggacctccgtcaaaagctggggccgggtctccaggatcagccactcccggcagtaccgggcggtgacgccctggggcaggtccacccggctctcccggccccagagggtatcccgggtcaggtgcaggatgtcctgcagatgggcggctgtgatatccctccgccccacgcccaaaaggtcgaagagccgcagcagcatccggggtcgcacggcgtccgtggcctctgccaatgcctgccgggataaggtcacccgcccctcctgcacctccacatgggcagtacggcgggcggcctcttcctccagtgattggtccgccacccgcaggcggcgtccggcgtcgttgatgtgctccacagctctggggttgatctgcctcaagcggggcatgacctccagccggaggaagtttcgggccgcggcgccggggtcggcgttggtggtgtcctccacgtgggggatgtggcgggcggcggcgtaggccgccagctcttcccttgtcacgtccagcagtggccggcaaatgccgttttgctggtaggccatgccggtaaggcccgccacgccggtgccccggatcaggttgaaaagaatggtctccgcgttgtcatcggcgtggtgggctgtgtagattttgatatgctgccccagcttctccgcctcttggcgaagaaaatcgtaccggagcttccgggccgcctcctccagggagaggccctcccgctccataaggccccggacgtccccggagctggagacgaatgcgatgtcatgggcggcacaccagtcccggacgaaggtctcatcccggtcggcttccgcgccccgcagccggtggttgaagtgggcagccactacccggccatcccgctcccgacaccaccggtccagcaggtccagcaggcacatggagtccagcccgccggacacggcacacagggccggacgcccccgaccgggcagcacccaccggggacagtgggacagcagttcctccatgtccgtacctcacctctcccaaaacagacctcagtcctcgtcgtacctcgtatccaaggtcgagaactgggtgtattccggcatccaccgcagctcctcccccggcacgtctgaacgcgccgggggaccccggcggccactgaccgggggcagacaaagtccgccccctgcaaggttttggccccgccaaaacacttgacgcacgtccgtgcggctttgcaaagcagagcacagacctcagtcctcgtcgtacctcgtatccaaggtcgagaactgggtgtattccggcatccaccgcagctctactttgccggtctcaccgtggcggtttttcgccacaatgcactcagcgatgttgtgcttctccgaatcctcattataatagtcatcccggtacaggaacagcacgatgtctgcgtcctgctcgatagcgccggactcccgcaggtccgacagcatgggccgcttgtcgtcccgcttctcactggcgcgggacagctggctcaggcagatcaccggcacgttcagctccttggccatgatcttcagcatccgggagatgtcggacaccacctgctggcggttctcccccgcgtagcccttgccgccggcagaggtcatcaattgcaggtagtcgatcaccaccaggcccagatcatccagccggcggcacttggcgttcatgtccgccaccgacagcatgggattgtcgtcgatccggatatccaccttattcaggatggtggcggccccggcgatcttctcccagtcggtctcccgcagggcgccggtcttgaggcggttgttctccaccaatgcctcggaggccagcaagcgggtggccagctgttcccggctcatctccagagagaagacggccactgtcttgtggacggccttggccacgttcagggccacgttcagcgcaaaggaggtcttgcccatgccgggccgggcggccagcaggatcaggtccgatttgttcaggcccgtgatcttctggtccaccgcggacatacccgtggagagccccggcaggtgattctcgctctcgctcatctctcccagccggtccagcacctccggcagcacctgccgcaggggcaccatgtcctgggcgctctggccccggcggacggcgtaaaccttctgctccgccgcctccagaatttcggaggcctcgcccacgccctcctgcaccatggcggtgatctcggcggcggcctgggccacgccccgcagcaacgccttgtcccggacgatggccgcgtactccatcacgttggcgctggtgggggtgatctccatcagctgggccagataggaacgggtggtgttctcgtcgtaggtgcccgccttctgcatctcctcacagacggtaatgccgtcgatgggcttggcataggtgaacatggagtagatggtctcaaaaatctcccggttctgccggaggtaaaaatctgacggccggagcttgtccatcacatccttgacgcagtccgcgtcgatgagcatggagcccaggacggcttgctccccctccagagagtggggcatctgccgcaggagaaggtcttcgtttgccatcttactgtcacctcgccgtgaataggagtccacctgtttgggttaggaaagcgcgaagggccattgtaccagagcgcgccaagcgccttttctcttccaccgggcgcggcgcactctctttttggcacagccaaaaaagagagcgggggcgcacccctgcgggcgcaggagcccccgagactgccgcaatggcggcccattcctctcccccagagcgtgcccccaaacagaggaactccctttatttttcctcaaacacggagacgtacaccgtcccgttgacctcaaaccccagcttggccttcacctgataggatccgaacgccttgatgggctcgtccagcaccagcttctgcttggggatgtcgatgccgaactgctgcctaagcccgtcggagatctccttggtggtgacggcgccgaacagccgcccgccgttgccggccttggcggtgagcttcaccatgcactccttcagcttctcggcggtggcctccgcctccgccttctgccgggcctcctcagccttgcgggccttctccttcaggttcatggtgttgatggcgtccgccgtggcggcgatggccagcttccggggcaggaggaagttccgggcatagccctcggacacctccaccatctggcccttttttccctggcccttcacatcctgctgtaaaatcactttcatgataacgtctccttttagtcgttctgtttctgaatttgttcctccagctgccgggtccgtttttccagcgcctccagccggtcattctgatgaaccagaatgcacaccagcaccgccagaaccagggcgatggacgcgcctgccaaataccagcgccggctgaaatcaaagagctggtatcctccgaaaaagatgaatgcctccaccagcgccaagcagatgccaaatgtggaaagaaatcgcttcatggccgcgctcctcctcacttttcaaaatacgcgtcgatggcctccagcagacgactcttcaccgtctccacatctgtgttctccacacggccgccggcagtggtggagttgccgccgccgcccagggcctccaggatcacctggacgttcacctctcccagagaacgggcggacatctgcacgttctccccactggggaataccacaaaggacgccttcacgcccttgaggctcagcagctcgtccgccgcctgggccgccgtcacccggtccacgccctcctggtcgatggccgccacggcgatgtcctcccggtacagctccgcccggcggatgatgtcgtagcgggacaccatctcgctcagatcgctctggaacaaccgctggacgtcggtggtgtcggcccccgcccggcggaggaaggccgccgcctcaaaagtccggccgccggtgcgcagggtgaagtgcttcgtgtccagcacgatgccggccagcagcgcctccgcctcctcccgcagcagatcggcgggctccaccagatactgcaagagttccgtcaccagctcactggcggaggaggcatagggttcgtggaagctgaaggcagcgttttcgatgtagctggccgcccggcggtggtggtcgatcaccgccacccggttgctggactccagcagctgggggctctccaccatgtcggggcggttggtgtccaccacaatgaccagagcgcccggcctcattttcaaaaatgcctccgccccggaggtgaacgcccccgcatactccggcaacgcctggagcttggccaaaaccgctccggcggcgttgtgctccagatcaatgaccatctgggcccgcttgccgtgcttgcgggcaatgcagtagagccccgcctcggcgcctacggcatccatgtccgcaaagctgtggcccatgatatagatctcggacgcgtcggccatcagctcgttcagggcgctggccatgacccgggacttcaccttggtgcgcttttccgtggacttgctgcggccgccgtagaactggaagtccacctttccccggaccaccgcctggtctccgccccggctgagggccatctccaggctgagacgggcgttgcggtacagctccgccatagcgtcggcatccttgccaatgccgatggagagggtagggcacacatcccccaccttgatctcccgaatggcatccaggatggagaacttctcctccacaaagtggtcgtagtggcattcctcaaagatgaagaggtagtggtcccgctccgtcttcagcagcaggccgtcggcgcaggcggcccagttgttcagcttctcgtcgatctgggccagcacggcgctgcgctgggtatcggcgcatgccttcatcaggtcctcgtagttgtctaccatcaaaatggccagcaccggccgggtggcggtgtaccgctcccgcaggtcgtcggcctctgtggtatccacccagtaggtagtggccaccaggttctgctcggccccccggcccttggcccgcaccaggctgccgtacacccggaaccgccggctgttcatcaccacccggtccgggcactcctgctttccctccagcatccactgaacggggaaatccggtactgcatcctccaccttcatctcgaacaggtgctcccgcacgccggccagctgcaggaagttctcattgctccagatcacctcgccggtgtccggccggaacaccatgatgggcagcggagagttgatgagggtggatttgctggcggtatccacgctgccggtaacgttatcaatgtactggaggatgttttgccgccgcttctggttacggttggtgaaataggcatacaggcccacggtgcaggcgatctccaccagtcccagaggcaggctcaccgtggcggtggccgccgcgaagacgatcatgcagaggaagtagagcttgagattgggctccagcaggcgggagagcttcttgttgttcatctcgatcaggtctccttttgaaagggacgcatacatacccatattgaagaatagtatagcagtttttcccacaagaagcaactgttaaaacaggcccgggctgatccggcccgagcctgttttgatggtcctcaggatgccgccgcggccgtccggcggccgttggcgcgcagaagcagcaggttcagccccagtgccgccagggcgaacattgccgccggcaggcccaggggcggaatccccacccctcctgcacggcgctgccgatgaaagagccgatagcaatgccgaagttgtaggataccggctgtacggaggcgcacaggctggaagcgaaagggtaatcctgctctgctagggacagcgcgtgcatctgggccggggtgttcagcaggtacatgagcagccccatggcaaagacccccgcaaggcccgcccaccggtttcccagcagcagcggcagcagggcaaacagcaccgtctgggcggcgaaggccatgggcagggtccggaggccgccccgctcccccagccggccggagaggagattgctggcggcgctgcacgctcccatcaccagcagcagcgggctcaccgcccccgctggaagccccagtgtctctgtcaggatcggcgagagataggtgtacacgatataggtggcggaggcgctgcacaggatcatccccacacacagggagcatcgggggtcccacaggatggaaaaggacttcagaagcccgctgtccgcctgtgccggcaccgcgggcagggagcgcagcagcagcggcagcagcgctgcgcccatagccaggatcacggcgaaggtccaccgccagcccaggatctggcacacggcagtgcccaggggcactcccagcaccgctgccacggaaaagccaccgtataccagcgagatggcccgggcggtctgctccggggcggcgacctccttggcatagagcatggccaccgccgtcagcgtaccggacaccagcgccgccactacccgggtggcatacagcaccgccacattaggagcggcaaagcttgccgcgctggtgaggaggaacacccccatcagcaccgccagcagcttccggcgggagattccgccggtagctgcagtgatcacaggcgtccccaccgcgtagcaggcggcgaacaccgataccagctttcccactgccgccagagaggtgttcagcccctccgcgatctccggcagaatgcccacaatcacaaattcgcaggtccccagcacaaatcccagggccgccagcagcagtaccgctccaggcagcggctttttcgtctgttccatgacacggttctccttctgtttgcgtacacagcttttcccaaaaacagcttcccccagagtcggcctccgcgggaagccggcgccggagaaagtctttcagcagttctccgccgtgaggatggggctctccggatagaaacagtcccgctccggcgtccggtgctccaccactgcgtcgaacagcagcgacagggccttgcggctctggtaggtcaggttctggtcaatgatgaagtccagcagtccctcccgcaggaaggtccgcgtctccgggctgttgtcgtgggccagaacccgcacctgccccatccggccggccccgcgcagggcttccatgcacgcaggcacggagcggttggccatgtagatatacttcaggtccggctcttccgccaaagcggcggtcaccgctgccagtgtctcatcatagttgtcgtgggtttctgccacccggcagtcctcctgccggagcccccgctccgcaagccgctccagaaagccgtctgcccggcccttgtgtccggcgtagccgtggtcggcgtacaccagcaggatccggtctccgggcctgaggaacttggcggcgatgtccccggccacccggccggcgtggtgggcgtcctcccccacgtagcacagccgccgggcgcctgcaatgtcggagttgaaggtcaccaccggcatccgccgctccgccaggagctccagcttctggcgcacctgggggcagtccgcggcgcacagggcgatcccctggacctcctccgccagcgtgtccagcaggtgcaggcagtcctccatccgcccctggcggtacgggtggatggtgacgctcacattgtagtcctgacggtcctgccggaacttcgccacgccagcggccatggcctcgcccacatagctctcccacgtgggctggatgatagcgaaatgccgggccatgccgctggtggccagggcgctggccacccggtttggctggtaatccagctcctccatcacctccagcacccgccgccggacctcctccttcacatacggccggtcgtggagcacccggtccaccgtgccgatggagacgcccgcccgttctgcgatcatcttgatcgttgcccgcatgtcccttcactccctttctccggcccttccgccggtcatcttggttttcttgaaaaaaatgtatacaaaacgcttgacctgtgctatactaggggcagaatggtgcggccttccgtgtccgccggcggcaggccgccggctgtcggagcgccgcggggcgtgcctctgcctgggccgcgccttcgtttcagtataacaaagtgcgcgtcgagaagcaactgcttttccgcccttttttacacagttccacagtatttcactggtgcggagcgccgctccgcctcagtcaaataaaaccccatacggtttcaacggaatgacgtgaccgaacccctgccggcgaaacggggccgcgcaggctacgggcgtctcttgtttgcgtgcgctcattttgcgccatttccgctgttatgggggtattttacatattttttcaaaggagtatcatcgatctatggcagaaaaattgaaaatcatccccctgggcggtctcaatgagatcggcaagaacatgaccgcctatgagtacggcggcgagatcatcgtggtggactgcggcatggccttccccggggacgacatgtacggcatcgacctcatcattcccgacgtcagctacctcatcaagaaccgggcccgcatccggggtctgttcatcacccacgggcacgaggatcacgtgggtgccattccctatgtgctcaagcagttgaacatgcccatctactgcacccggttcaccgcggggctcatcaagctgaagctggaggagcatgggctggtgaaaagcaccaagctcatcacggtggagccgggcaagagcgtccgggccggcaagttcactgtggagttcatccatgtgaaccactccatcgccgactccgtggcctttgccatccacacccacatgggcaccatcgtccacaccggcgacttcaagatcgactccacccccatcgacggggaggtcatcgaccttgcccgcttcggcgagctggggaaggagggcgtcctggcactgctggcggactccaccaatgtggagcgtccgggctttaccccctctgaaaagacggtgggcgccaccttcaagcgccagttccagggatgcgaggaccggatcatcgtcaccaccttcgcctccaacgtccaccggatccagcaggtgctggatgccgccgcggccttcggccggaaggtggccgtgacgggccggtccatggaaaatatcatgaaggtctccacagagctgggctatatgaaggtgcccaagaacaccctggtggacatcaaccggatcaagggcctgcccaagaacaagcaggtcatcgtcaccaccggttcccagggcgaggagatgagcgccttgtatcgcatggccttctctcagcacaagcaggtggagatcggcgccggggacaaggtcatcatctccgccagcgccatccccggcaacgaggtgacggtgtcccgggtcatcaacgagctgttccgcaagggcgtcaaggtggtctatgatcgggccgacatgcttcacgtgtccggccacgcctgccaggaggagctgaagatcatccacgccctgacgaagccccggttcttcatccccctccacggcgagcagcggatgctccagatccactcccagctggcccaggacatgggcatggaccgcaaccatatcgccattgccgacaatggctccgtcatcgagatcacggccaagaccattaagttgggcggcaccgttccctccggtgaggtatatgtggacggctccggcgtgggcgacgtgggcgccgtggtcatgcgggaccgcaagcgcctggcagaagacggcatggtggtggtggttctgcccatctccgcccatgacggcaacctcctcagcgagccggagatcatcacccggggcttcatctacgtgaaggagtccggggacttgatgaaggaactgcagagcgtggcccgggacgcggcggagaacgtctcccgcaagcggggccgggatgacggggaactgaagggttccgtcaagtccgccgtcagcagctacctgttcaaaaccaccaagcgcaatcccatggttatccccgtggtcaccagactgtgacataccagataacgggtgtgcagataagagagccgcagggaaagcggcatctcttatctgttcgctctgattcttgattttcagggaggtctacataacaatggcactgcaagccgcatttctctttcttatcggcgatgccgatgagaccacccgcaccgtggtatccacccctagcatccatttgaacgtggtgggctgcaagacctacgctgaggcggaggctgccgcgaaggagctggccgccgtaggcgtcaccgctatggagctgtgcgctggcttcggcaacgagggcatcgcccgcatccagcgggccgtgggtcccgacgtggccgtgggcgcggtgaagttcgacttccaccccggcctgggcttcaagagcggcgatgccctgttcggctgagacgcatgaaagcggaaggactttcgtccttccgctttttctttttcctgcacggcccgcggggaatgcagaactgcggcacgccgcgccctggcaccggcggaaccggacagtctcatccgccgcccggcgggtcccgccagctcatgccccatctgcggcgcgccggtacttctccaccatcgtcccatactccggaatctcccggaggaaggcgcagtccgggtccgcctccacctggtccagaaggggctccagcagcaccgactgggcctctccggcggcctccttggtggccagatgccggtacaggggcgaggcgctcagatcccaaggcactgtcaggctatgcagcagccggtccagcaggtccagcgccgccgggccgtcctgctccgccgccgccagctggaagggggcggacagcactgcgtaatcgctcaggtccagggcctctcccgcccgccgggcggcgtcgcaaaagccctgggcccgctgccggtctccctctgcctgggccatctcgatcagggacagcagcgtggtctggatgccgtgggcccggtcgaacagctcccgctccagcagggtccaggcctcctcggtccgcccctgcttccgccgcagggcggacagcacttcccgcttgtcccgatgggtgttggagatctggtccagcagcgcctccgcccggtccagatccccccgggcgatgcagcggctcgccacggtataggtcgcccactcccggattttggggtccgcgctctgggcggcctgctcgtacaggcccgcgacaaagtcctcccggccgggccgggctgtctcatcggtgccggggaacagggtcagaagcccctccagcagccccgcagcgctgtatgccagcgcgtcgctgttggggaactggcgcagcttctcctctgccagggaaaaggccgcgccgcacccatcggtccgggacacctcgtacagccggttcaaaaactccgcgatctccgtctccgtcaagtcctcccgaaaggacaacagtgtgttcaggtccacccgcagcgtccgggccagcaccggcagcagggtgatgtccgggtaggagtttcccctttcccatttgttcaccgccggggctgatacccccagcttccccgccagctgctcctgtgtcagccccagtgccgtccgccgggtgcggataatctcgtggatctgcatggcaaagccccctcttgtgatctgtccccagaataccatctccggcggtgcgctgcaatcgacaggtgttcaatttttctgacgatcttttaaccggcggttaatgggtaaaaatcgctgtaatcactgtgccccaaaccgggcttccggggtgcgcctctcattgggcgaacctccccgcgtagacagggcagaactccagaccgccgcgggcaattcagcgggacgcagactgcacctgaccctcccggccgcagcaggtcccgaccgaagcccttacggcgcgggtctgtatgggatcatgggaatacgctcttccggcaccggctcccatcgtcccggcaatggacatgaagggctgcgccctctgccccaatttgcaaaatacaggcgcacagcttttgctgtgcgcctgtactgcttttccctcactcccccttggggtcctctgtgtcgaacaccgtcttggcgctggcagcgagtcctgccagcccctggagctcactgggaatgatgatcttggtggccttgccgtccgccaccttctgcatggcttccagagccttcagcttcaccacctggtcattgggggcggcggcattcagcagcttcagggagtccgccagggcggtctgcacctgcatgatggcctgggcctccgcctcggcggccatgatgcgggcctccttctcgccctcggccttcaggatggcggcctgcttggcggcatccgccttgagaatcagggactgcttctcgccctccgccaccaggatctgggactgcttctgcccctccgcctggaggatggactcccggcgctcccgctccgccttcatctgcttctccatggcgttctggatctccttgggcgggataatgtttttcagctccacccggttgaccttgatgccccaggggtccgtggcctcgtccagaatggcgcgcatcttggcgttgatggtgtcccggcttgtcagggactggtccagttccatctcgccgatgatgttccgcagggtggtggcggtcaggttctcaatggcgttcatgggccgttccacgccgtaggtatacagcttcgggtccgtgatctggaagtagatcaccgtatcgatctgcatggtgacattgtccttggtgatgacgggctggggcgcgaaatccgccacctgctccttcagggacaccttcttggccacccgctccacaaagggcaccttcaggtgcagtcccacgccccacacggtccggaacgctcccagccgctccaccacataggccttggactgctggacgatgacgatgttcccgatcagcaggatcaggatcagcaccaccaggatcaacagcggaacccacttgagcacatccatcatattcacacaacctcctcttttttatcaggcgctttctgcgccgcttccacaatgagcttcacaccctccatccgccggatctccacccggctgcccgccgggagcaccgatccgtcggcgctgcgggcggtccaggtcttgccgtccacatagacggcgccggaggcgctgtcgttgtcgatggtctccgtgactctggcggtgcggcccagcacccggtccgcgttggtaggcacagcccgcccggcggagagctttttcaccaggggccgggtggccgccagggccgccgccgacaccgccaggaacagcaccagctggatcaggagccccgcccccgccatggcggcgatcagacccgccacggcgccgggcacaaaccagatggagaccagcccggcggtcaccgcctccaccacgccaaagaccacgatggccgcaatccacaatgccgtcatttcgctgtctccgcctcctttcaaatacagcatacacagggccaccagggcagtcactgccgccagccccccactccggcccatttgttggccggggacaggttgctcacaaaatctcccagcgccgttttcagtgtccgggactccatccgctccggcgccgccggcgtctcttggccgcccagggggacctcctcgcagaacaggtcattcatggtgacgccgtagcggttgcagatatagatgatcttctcaagctccgggtatccccggcaggactcccacttgctcaccgcctgccgggagaccttcagctgggccgcaaagtcctcctgggtcatgccccgggcccggcggagctcctgcaaccgctctccaaatgccatacgcctctcctctctgtctgtcattttagcagaaccgccccgccgtttccaccaactctgctttgcatccggcaaaatcccgtgcaacttcaggtttccgtccgggaagtgcggctccggcggcgtttatcgttattgtatcatgcccattttgcaaataccatttcattttggttacaaaacctcccggcccgccggcggcagttgcggcaagagccggcgggcatctcgacattttccgcagtctgcattataataggaaaaacgccccgctgaggcggaggcagcaaggaggatgttccatgcgtcagccaagaagtgcgaaggccaatccctttccatacagaggcagcctggtctgctacctgtctctggatgctgcgggcagtctcacgcaggtgggccacgatttctcctctgccgcagaggcctaccgccgggccgctgccggagagatccggctctatgccgtctggcccggggaatacagcagcgacctcttcgagattgacgatctgaatgcatttgcagacgcttttggcgtggagcggccggacccccatgtccacgatctggcgtggacgctcagcccgatggatgacggaacatcccgctatgcgaatgtgaatgttgtcttccgctgcggctgtacgctgagcaagcagaacatcaaaaagttcgccaacgacatgcgccgccagatgggttggaatgtggcgacttccacggtaccgggatgccatggcagcgccgacgggtcggaggtctacaccattcgcgtggagcgcagaacgctgggccacgccgccccctgagagcctctcttccaccggctccaatgaaaatccacgggcatctgtatgccccgccaaggaggaaccccatgaaatacaccattccctgcctcttcgggctggaggccctggtggccgacgagctgcggcggctggacctgaaaaacgtccgggccgaaaacggccgggtccactgcgacggcggcccggcggacatcccccggctgaacatcaacctgcgctgcggcgcccgggtgctggtggagctggccagcttcccggccccggatttcgaggcgctgtttcagggcgtggccgccatcccctgggaggattgcatcccccgggacggggagttcccggtgaagggctactccatctcctcccagctccactccgtccccgcctgccaggccattgtgaaaaaggccgctgccaagcggcttggccaggcctacggctgcgagaccctgccggagaccggggaccgctatcagatccagttcgccctcatcaaggacaccgcagccgtgtacctggacacctccggcgacggactctacaagcggggctaccgggcccacaacaacggcgcccccctgcgggagacgctggccgccgccctggtgctgctctcccgctaccgggggagggatccgttctgcgaccccttctgcggcagcggcaccattcccatcgaggcggcgctgatcgccaaaaaccgggccccaggcctggaccggcgctttgccgcccaaaagtggcagagcctccccgccaagctgtggctggacgcggccgaagaggccatggatcaagaattccacggccagtacgacatctggggcggggacatcgaccccagtgcggtggagttgagccgccacaacgcggagctggcgggggtggacgactgcgtgcgcttcgaggtggcggatgccggaaagttccaccgggacagcgactacggccagctggtgaccaatccgccctacggtgagcggctgctggaaaagagagaggcggaggccctgtaccgctccttcggcaaagctgcccggacattgccggcgggctggcgcgtgctggtgctctcctcccacacagagtttgagcgcgccttcggccgcagcgcggagaagaaacgcaagctctacaacggcatgctcaaatgcgacgccttcttctaccacggaggcgcaaagacagagccagacaaaggttaaaagacaggagagatcgccgctgacagtcctcatctttcatctcttcactcttatctcatatttcgccaagggggcctgtcatgcgccatgtctttttgatcaacccccatgccgggaagcaggaccagactgcccgcatccgcgccctggcggaccgtctggccgcggcccacaatctggactgccggtgcctgctgacggaccgccccggcggagcggaggtcctctcccgcgccttggcagagaccggggagccggtgcgcatctacgcctgcggcggggacggcaccgtccacgaggcggccaacggcatcgccgggtttcccaacgccgccatgacggtaatccccgccggcacaggcaacgactttctgaagaacttcggcccggacgctgcaaaattctccgacccggaacatctgtgggacgggccggaattccccctggatctcatcgactgcaacggccgcctgtgcctcaccatcgcctgcagcggcattgacgcccgcattgctgacaccgtccaccggtacggaaatgtgccgggcctctccggccgggggagttacctgctgtccgtggcggtgaattttctcttcaagcccatcggccgccggtggcgggtggagctggacggggaggtcctggaggatgacttcgctctggtgtccatgtgcaacggccggtactacggcggcggctccatgccggtgccggaggcccggatggacgacggagtgctggagaccatcctggtgaaaaacgtgccgaagcgcaccttcgcccggttgttcccggcctactccgccggggagtattggaaatttccccacatcgcccgaatggtgacgtcccggcaggtggtgatcaccgccagccccggggaggcggacatcgtcacctgtctggacggggagagcctccggagccgggaggtgcggctggtactcgcggagaagcgggtgaacttcttcgggccgaaggggtgcagtcccaatgccacggcaggatttgaccgaaagccaaggaagcgtcgatattccacagcttttctgctattataggcatcctacgatcattcaaccgctgcgcctcggcacggtataatagtcaactagaataattgataaatagaggccaggacacacccgaaggaggtgtcctggcctcttaatttttcattcagtgctttcctgcttccatttatggcttgtcgtatcggaatgcagaaacgatataggcaattcttgatgttccgtaaggcacaatccccccataaccaaccagataaaggcatattcccttgtcaggccaaaggcaatcatgccggctataatggtcataaatgaagcgtacagtgcgacccgaaatgctttttcagcgcatttcaattcgatatactgatttctctcatcctgttccgcaatcatatcctcttccgtttttttaggtttcagaagggaaatgccggccagcagaacaataataaagagagcaacccctgcgatagctttttgcgaggttgtgaacgcggtaatatcacccagataaaagctgccgaaggcagccaataccaagagcaggcccagcatcttaccctttccgccaaataattgcatagttatttttcctccgctccctcgtcctcgccgtcaatatgcagggccattaccatgtgataaagagctgcaagtaagcagatacctatgccgataaccgcctttggaataccatgcgtagcctcggtaaatatacaaaatcttgatattccaataccaacggcaagcagtaataataaaatcccccggataaacattttcttatttgtgatcttcatcctgattttcctcacattctacattttctttcaagcagcacaactcttcaacggtcgtatgaaatacctgtgcgatcttgtaggccagaacaagcgatggattgtattcgcctctttctatggaattgatcgttcttactgtcacacgaacccggttcgcaagctgctgctgcgtcaatcctgcggcagttcgcaaatccttgataatcgttttcacgctcctcactcctcaaataggaagttaacttcttaggaagctgacttcatattaaattagggcagcgaaaatgtcaagagaaattttaagaagcttacttcctattgaacagtgaaaaagccataaaaatattgcattaaaggcgcgtcagcctccgctcctgtccatggcggcttgccgttcatctcgaccattgaccgaggccggatgctgtgttgaaaaatttttcagggaggtatgggataacccgcaacaacagcatataaagaaacctcgtattatacggaacacttgataaaaatcaaaaatttctttatatttggaaactttttcccgtgaattgtacagtatttgcgccggtgaaaatcgtatccgtgaagaatgcgtaaccccaagcagagctgtttcatgcggcacagtgagatgtgaagccgtcagtccgcctgaggcagccgtttgggcagaaagctggtcatgacagttgaattctcctgtccagcaggacggctcccatgcgctccccttctgagagggagattttttcggaattcacaaattcttcatagataccccctttacaaatggaaaacattgcgctatgatagcagcgttagcactcgaatgatatgagtgctaacgctgaacttgtttttcaaatttttatttctataaggaggaaccccattatgaaactcactccgctcgcagaccgtgtcattctgaagatggtggagaccgaggagaccaccaagggcggcattatcctcaccggcagcgccaaggagaagccctccgtggcggaagtcatctccgtgggtcccggcggcaacgtggacggcaaggacgttgtcatgaccgtgaagcccggcgacaaggtcatcaccagccagtacgccggcaccaaggtcaccctggaggacgtggagtacgtggttgtccgtcagaacgacattctggcgatcgtggaataaatctcccgctcccgcttgcaatcaggaatcggaaattgtggagccgcctgcaacggccaatttcaaatcgtttggctctgccggacgccaaaattcccaattcctaactccccatccctaatttatgaaacatgaagctctattacaggaggtttgattactatgtctaagctcatcaagcgcggcgacgaggcccggaaggccctggaagccggcgtcaactctctggccgatactgtcaagatcaccctgggtcccaagggccggaacgtggttctggacaagaagtacggcgctcccctcatcaccaatgacggcgtgaccatcgccaaggagatcgaactggacgatccctttgagaacatgggcgcccagctggtgaaggaggtctccaccaagaccaacgacgtggccggcgacggtaccaccaccgccaccctgctggcccaggccatgatccatgagggtctgaagaatctggccgccggcgccaatcccatcgtggtgaagaagggcatggccaaggccgtggaagccgcggtggccgaggtcaagaagcaggccaagaccgtggacggctccaaggacatcgcccgtgtcggtgctgtgtcctccggcgacgaggagatcggcaagctgatcgccgacgccatggagaaggtctctgccgacggcgtcatcaccattgaggagtccaagaccgccgacacctattccgaggtcgtggagggcatgcagtttgaccggggctatatcaccccctacatggccaccgacatggagaagatggaggccaacctggacgatccctatatcctgattaccgacaagaagatctccgtcatcgctgacatcctgcccatcctggagcagatcgtccagtccggcaagaagctgctgatcatcgcggaggacgtggagggcgaggctctgtccaccctgatcgtgaaccgtctgcgcggcaccctgaacgtggtgtgtgtcaaggctcccggctttggcgaccgccgcaaggagatgctgcaggatatcgccattctgaccggcggcaccgtgatttccgaggaggtcggtctggagctgaagagcgccaccatggatatgctgggccgcgcccgccaggtgaaggtcaccaaggagaacaccaccatcgtggacggtgccggcgacagccaggccatcaaggatcgcgtgggccagatccgcacgcagatctccaccaccaccagcgactatgacaaggagaagctgcaggagcggctggctaagctggctggcggcgtggccgtcatcaaggtcggcgctgccaccgagaccgagatgaaggagaagaagctccgcatcgaggacgccctgaacgccacccgcgccgctgttgaggaaggcgttgtggccggcggcggcaccatcttcgtgaacgtgatccccgccgtggaggctctgctttccagcgtggagggcgacgaaaagaccggtgtccgcatcgtggccaaggccctggaggctcccatccgtcagatcgctgccaacgccggtctggatggctccgtgatcctggagaaggtccgcacctccggcaagaccggctacggctttgatgcctacaaggaggagtactgcgacatggtctccgccggcatcatcgatcccgccaaggtgacccgcagcgccctggagaacgccgccagcgtctccgccatggtgctgaccaccgagtctctggtggccgataagcccgagcccccgctcccgctgcccccgccggcggcgagatgggcggcatgtactaagtgcaaaaaacatcaagccccctggctttcgccagggggcttttctcgtggagactcggcttgtcggcggagcacaagcatcaagcattgagtcctccactgcgccttcgagcggggtgagccggagtcgggaatcgcttgcgttccggctataacgccggaatacaggatacgaagcttgtgatggcaggaaagtgggggtgacaggctttgcagcggcgccccgcttccaccagcggcacagatgctgcacatactgagtaccagcaaccattaagccctttggctttacagccacagggctttttctcgtacgctggggttccatcagcgttgccctcccctgcccatactctggaaaccgcagtcggcatgcgtcatgggctatgcctctgctcatgtctgtccgacctgatacttcttcagcagccgccacagtgtcccccggctgatccccagttttgccgccgtctgcgtccggttcccgccgcattcctgaagaacggccagcaactcctcataggacaggtcgatcctggtatgggcggccttcggcatcggcggcgggcacgggggcggcgtctcgggagaggcggcactctccagcagatgggcgatcaggccagatacagagacgccaggccggtaaagcaccgccagccgctcacagaaattctgcagctcccggatgtttccccgccaggggcagctctgcagcagacggcagtcgccatcgctcagttccagcggacagccgtcgccctcccgagcctggaagttccgaaggaagctctgcgtcagcagcgggatgtcctcctgccgctcccgcagcgggggcagattcagctacaggacatacaggcggtaatagagatcgctgcggaatttacctgcccggaccagcgactccaggttcttgttggtggccgcgatcacccggatattgatgggagtcacctgactgtcccccagccgcatgatctcccgctcctgcaggacccgcagcagccgcccctgaagtcccagggggatctccgagatctcgtccaaaaagatggtgccgttgtgggcgatctcaaacaggcccggcttaccgcccctggtggcgccggtgaaggcgccctccacatagccgaacagctcgctctccagcaggttctccggcagggcggcgcagttgatggctacgaagttgttctgtgaccgacggctccaggcgtggatgctctggctcaacagctcctttccggtaccggtctcccccaccaccacgatattggagtccgtctgggcaaaggccttggcctcctggatacaggctatcatccgcgggctgcgggtgatgatatccccgaaggtgtacttggccttgtgtcccttgtagtggagctttttgcgcagctggtcctccgtggtctggatctgcgcggcgttcagcagggaaaccacagttccagcccggaggccgtgcatcatcatgtttttcgttttgacggacaggtgggtgtttttgtaagcgataatctcgtccgtgttctccgtcgcggacacgatgcggctcaacgccggggtggagaacacggaggatgccggctttcccagatactgttcccggcgggagagctgcaaaacctggatggcagctggaaccgggccgtatttctgccgcagctacagcaggatattgacaatgtccgttccgttgataatcagttcgatcacccggatagagagggagcggcagcacaggtccagatagatggcaccccgagcgatcatggcgtcgcagtccggccactgcggcaacagcccggataccccggccgatgacgcctcttcggaggatggcggcactgactggcccaccaaatccatcaacatgatcgttcccatgggcgccgggggcgacactgactttaatgcccgcacatatgcaaaatatctggaggatgtgttgggtgagaccgtagtcgtcaccaatatcaccggcaatggcggagcgctgggttccgaggaagtcaagaacgcctctcccgacggttatacctgcctgttttatcacacctgcctgaatatcaaccaggccaccggcattgccgactacggttccgaggcatttgagaccgtggctgtggtgggaaagagttccggcgaggccgtggtcgtgcggaccgacgccatgtatgatgagttgaaggccgcccccacggcaccgggcttccgggagatcatgatccccggggagatcgagttccatctgacccggcaggcggagcgggagggtatcgacatcagccccgccattgagcaggacttcgcggatctggccgtcaggtacggcgtcccgctggaactgctgcaatcctgctgactttccagtggaatcggctgtcccccggcccctgcgggccgggggacacacagacaggaggaatgaaatgcacatcgtcattttggacggatacacggaaaaccccggcgatctcagctggggagaattggagaagctgggagacctgacggtttacgaccgcaccagcctcaccgatgaggacgagatcatctcccggatcggcggtgcggaggtggtcctcaccaacaagacccccatctcccgccgagtgatggacgcctgtccctccatgcgcttcatcgccatgctggccaccggctataacgtggtcgacatagcctgcgcaaaagagaagggcatccctgtctccaacgtgccggtctacggcacccattccgtcagccagtttgccatcgccctgctgcttgaaatctgccatcacatcggttatcataatgatacggtaaagagcgggaaatgggaacagtgcccggactggtgctactgggactaccccctgatcgagctggcgggaaagacatacggcctgcttggctgcgggaacatcggcatccacactgccgccatcgcatcggccctggggatgcatgtcatcgcctacgacatgcgccagcgggacgaagctctgcagctgggggtggagtacgtctccctggacgaactgttcgcccggtccgacgttctgggcctccaaatgcccctgttccccttcaacaccggcatcatcaaccgggagaacatcgccaagatgaaggacggggtcatcattatcaataacagccggggccagatggtggtggagcaggacctggcggacgccctgaactccggcaaggtggcggccgccgggctggatgtggtgtccacagagcccatccggggcgacaaccccctgctgaccgccaagaactgcatcctcaccccccatatctcctgggcccccagggagagccgccagcgcatcatggactgcaccgtggacaacgtgcgggcctaccttcagggcgcccccatcaacgtggtcaacccgtgaccggaccggggcgggccttccgcccgccccgcgcatccagagaggaggaaactcatgtcaaagtggattctcatgccggactccttcaaggggaccatgtcctccctggagatctgccagctgatgcgggaggcccttctgcgccacgtgccggatgcagaggtggtctccattcccgtggcggatggcggcgaggggagcgtggaggcgtttctggccgccatgggcggccaccgggtagaggtgccctgcaccggtccggattttcgtaagatctctggtttttacggtctgctggccgatggctacaccgccgtgatcgagatggccgccgccgcaggcctgcccctgatggaaggccgtctctgtgctgagggagccaccacctacggcgtgggagagctgattctggcggcgatccgggacggcgccaggcgcatcattctgggcctgggcggcagtgccaccaacgacggcggctgcggctgtgccgccgctctgggcgtccgctttctggacggcaccggggcggagtacgtccctgtaggcggcacgctggaccggttgtgccggatcgacatgtcccatcgcttccccctgctgaacggtgtggagatcgtgaccatgtgcgatgtggacaaccccctctgcggtcccaatggcgccagcgccgtcttcggcccccagaagggggccgaccctgatatggtgacccgtctggaccggaatctgcgccacctgtcggaggtgatccgccaggacctgggccgggagatcgcagaccttcccggtgctggcgccgccggcggcatgggagccggtgtgatggctttcctgggcagtcgcctgcagatggggatcgagacagtcctggacaccgtgggcttcgatgccctgctgcctggtgccaccgcggtcctgaccggcgagggccgtatcgactgtcagagccttcggggcaaggtggtcatcggcatcgcccaccgggcccggcagacacggatcccggtggtggccgtagtgggcgacgtggcccccggcgcggaggacgcctatcaagagggcgtcaccgctatcgtgtccaccaaccgtcgcgccgtgccctgggaggtagcccgccagtccgcccgggcagatctgtgcgccgccctggaggatctcttccggctctacaatgcgttccggtccgcccgatgacatgagtggatttttgaaaagacggtgccgggcggtaggagccgcccggcctcattcccaccgtatccgggctgccggcctcggggcaccctgccagcggcagcgagtctctcctctgcttccggttttttgaaatttttcatttttttcgaagaaacacttgacaaacgccgccgccttctggtatagtaattgatgcccgttcgggttagacatttggcggcatagctcagttggctagagcatgcggttcatacccgcagtgtccccggttcaaatccaggtgccgctaccagatccatgaagcgccccggcgcttcatggacttccaaatggcccgttggtcaagtggttaagacacggccctttcacggctgtaacatgggttcgaatcccgtacgggtcaccatcccataggacgccgttgtgcacggcgtcttatgggcagaaaaaaattacatatccgtatggaggcttagctcagctggttagagcgcctgcttcacacgcaggaggtcactggttcgagtccagtagtctccaccaaagaaaaccctagagccgcaaaggttctagggtttctctttattcaaaagattttatgtttgttagtaacgtgtaagtaacattacaatcctctaatcttccgcattaccccgttatacacacgggggttagcaacttgtagcgtgtccatcaagtcatccataatgccccatacctgctcctcgtttctcccttcaacctcgcggagaaattcgctgtctccgtatctcccgacctctacaggtatttcagccggagccgcagaataggcttgctcataggtgcgattttgcatttccggttcttgcttctgcatctggttcttgatggtgtacaaggttgccaatttagcgtatgcgggatagctgctttctccatattcgagacgtgcaatctcaatgtcgatctctttggggtctagcatagggggcaccccctatcaatcccgacccagttcggacataaagcggcgaatggcgtcgcgctccctctcagtagtagcgttatccatcatctcctgagcctgctccatcatagcctctttggagtcgtggcggctgtatccgccgcgcccgtcacgggagtagccgccgtcccggctgtagtggccccggacatagtgcttgccacggttggcatagctggagcctctggcatagctggaaggagagtccatgtcggctgcctgactgtaaccgccctcctctagcatcatgatcttgtccacgttcttgatggtatccgtcagcttgtggaccatctccaggtccccggcgttcatgttgcttttctgggcatattcctccagctccttgcagagcttttctttcaggtcatacagatattccatatcggttctcctttcacgcgatgcgctcaacaataaaattactgttggcaacgaggatgggctgtgtgctggtgttctttgcggcgacagtgacgcagcagccgcgagggacatctaccacagcggaaacataaatattgaagaaatcctctgcggcagccggggtgatggtagcggtggaagcgttcagcgcctcaccattgatggagatcgctgccgtgatggcctccacggtcccaccagtagggatagcaatattcgctccaaaggagactttgaatttcgcgcggcactggttcgtaagcccgcgaagagtcaccagcccagcgccttcccgatgcacaatgcagggcttgcccgtgttggcctcctcagtaaaaggcacgttctgaccagcggcaacggttacgattgcgctgttgctgtattcagccataaacttcattcctttcaaaaagatagcggcgaggctgttgccccgccgcatggttcaaaatcggcacggggccgaacatgtaagcctttcttacaagttgatgtattgggttttagcagccgcagccacagggattgcagccgcatccggcataaggattgggcacctgataggccgggacaggcatgggattgatgcggcggatcagctcggcagtctgcgcttcctggttagcggtaataaaagcattctgcgccgcctgagaagcctggaacttcaggctctggttttcagccgtcagagtagcgatcttgtcctgggtcaggaagtccaggatcgcgcggctgttggcattggcgttgtcgatgatgtcgcgggtgctggactggatggtgttgcgggtatcgcaagcctgggtagccatgtcatagcggacaccgtcaatgctccgctgagtatcgcagcagcactgcgccagctgggcgccgagggcgttaaagcccgcctgcgtctgatagcccaggttgcacacagcggtatccacgccatggaagccgttgctcacggcatcccggatggaggtctggccgttctggagaccgttcagggcgaagccctcgttgatgtcggagcgtgtagcgtaaccctggaatccaggcccgtttgctccgccaaaacctccgccgaagccattaccccagccgcctccaaaggccccccaaatgagaaacaaaataatccaggcagaccagtctccaccccacatggaaccattgccgccatagccaccagcggaatacgcaggagctaccggcatagtcagagttgcgtcattactaagagacatataactttctcctttgtaaaaatatttataaatgcggccgcatctatatactttttgatgtttttgtgctataattgttatgcgtggatagggtcgctcccgacaagccgttaccctgacggtttccacgcaatctgacaatcagggcgcatgaaagggtaaatgcgatggaacaaaaaagaatctataaaccatatttcgatgtgaacgagtacatcggaaaacggagcaattacttgactgtaattggactggctgaaagaaagccagacgataccagttggaggttgcgatgccgatgtgattgcggtgggacaattgatgtattgccttatcaattcaaaaacggagccgtaaaaagttgcggttgtctcagaaataccatctacaccaaacaagacggccgcagtaagcatcccttgtatggaatctggcgacagatgatgcaacggtgttacaatgagaagtcaaaaatctatcgccgttatggtggccgtgggatttatgtttgcgaagaatggcatgatttttcaagtttgttgagtggtctgattctattggcggtaggccggagggttatacgctggacagaagggataatgacggcccctattgtcctgagaactgccgctgggcaacgatgaaaacgcagaatataaacaagtccgataacattgtgattgagtacaatggacggactcaaacgcttgtggaatgggcaaaagaattaggaattaactgggtcacatttcacaaccgatatgtgcgtggctggagcattgagagaatgatgacagagccagtccacacaaaacctgaccgaacggcgggggcttaatgcccctgctgtttatttcccaaacataccccgcatcccctcaaacatgccctgcatctgctgggcctgcttttggacttggttgagctgatcttgggaaatgcgtccagaggataccatctcttgtatcatggcgttggggtctttgccccgcatctgctgcatgaaggattgaaactgctgcatcatgttgggctgtctgttgccgcccatagcctgataaaacgggttcattctgcatcctccttatcttttgccgccagcgcatccaggcgggcctccaacgcttccaagcgggacaggggcgcatactctaccgttggagcctgcggggcctgtacgggcctctgattgcgctctacaaggtcatatatcttcatgctgggcttgccgcttgcgtccgcctgtttgagatagaccactggggcgttactgtcccacaaggtaacggcagagttaggcgccaccagataatttgccgcctccatctcgctctgcacccacacaatagacggagatgccggggcttgctgcggctgctgcatgggttgataggactgccgcagctgcgtcagctggtccgccataggcggctgatacggttggtacggctgatagtaatagggatagttcggcatctcacgtcatcctttctgccagtagtacagcacagtttcgtgttcactgtgccatgtatcgtagatcacaccatcctgcaggcataccacatggccggacagggccagaatgtaagtcccgtttggatgccccatcgcaaactccgccacggtcatatcctcgggcgccatgtcccgccggaagccatgccgccggaggtaagcgccccatgtggcgttggcgcttggcatatcacccctcacagcgccctcaatgcagaggccaagatatgtcctgtaccagtcctgctccagcgccttcgagatggcccggacggtgcaatcccccacatttttctcgtaggggttcggattgtaaaattcaaacatattgctttcggtcgtcatacaaaagctcattctgccggataaaccgttccaatccggagaaatctccctccgccgcatacttctcgcaggtgtctcttgctgtggactccgtgaagccacaggccaccaaccgggccaccagttctgaaccattcagaatcaacttaaaacacgtccttatcattgaaatcaggaggccgcaaggagggcggcgacgtgtaccagcccttgttccttacgtcctcctgatgatattttcgcaaaaaaagcccccgcctgggtggttcccaagcggggtttaggtgaaattatgtgaaatgtagtttttgagctgtgctttcaactttgcggagaatccgtttgagtcgataagagatggttgaccgctcccagccgaactccgctgcaatgtcgatctgcgggacttggtcgatcaggtagcgccgggcaatgtccgtatcgtcgttcccaagattagcttcccggatggccgtctccatctcggagcgcataaggccatccaggctatccggtaatctgacacgggcagttgccacagtttcacgtcctttcgatcagctcccaaagccgatgcaacatcgtgcacatctgctgccgggtaacgggctgggagagcatcaggtctccctcgctgttgcccgtcaggatgccgttctttacggcccattccacgccctccttgtgggcgccgctgggtgtattgtccatgatcttgacctccagtctcttcttgaactctgcccacttctgggcgttcaccaagtacgacgggcagtgcttcccagtcacgtcaaagtgacggtacacgttctcaatggggatgtgatacttctccatcagctcccggcccagagcggcagcgttggcaagggttgcctcgctggcctgatagacaccgttccggatggtgtcacacatctcaatgctgatagagttggtattggtgatgacgccgtacatggtgccgccgccagtcttgtcggcgttggcgtacttgctgccgccgacggaccacgcaatcttcagatcggggacggacagatatacggtggtatcgtccacaaagtaatgggcactggccttgacgatgttccgctggaagtacgcggcgttgtttgccgccttgtccccgtcattcccggtgtagtggtacaccagataccggatttggctggcattccgggaaccgccatagttcccggagttcgccagctgctcctttatcgtgtagctcatttactgtcacttcccagctgcttgattacctggttggctccggtagcagccagaccgctcacaatgcccacagccgccgcagtgatgtagtccgtggccgggaagtccggcataaggaacatacctaccacacccagcacagcaccgcagacaccgcaaatgatagggatgaacttgctgtccagagaggacgctttcacgccctgcccaatcagcaggcagatgacggtgatagccgccactccggtgatgccaagagaggaaatgtccatatcagacctcccgattacactcggatggccttgacggcataaccgtctgcatcataggtcacatcaaactttccgcgcttggtattctggcgaaccacttgtccggcaagcgcctgatttcggcccatgtctaccttgtccggaagaggctccttttcctcgccgggaaggaatccctccgccatctctgcctcggtccatccgccatcggggttcttttcggggttcagggagaatccggcgccagcctcaaccagcagcttgttggcatcctccacagtaatcttgccgctcttgaagtcatcgatgatgttattgatggtcttgttcatgattggtagctcctttcaaatttccggcttgaccgccggttgatgatgatgtaagatgcaggtgtgcccccctccttattgatgtggttttacttttttccatatcggggcactcgcggcgctccttcgggggcgtcgcttttttacagcccaatgcgggccaaaacaaacgcaattaccgccgccagcaccgcccacacggacttgtccacgatggcctcccaccgctttttcggcttggcctgctcggcctcctgccatgagatcagccggtccagcttctccatgatattgtcgtactgctcattccgggcggcctccgccttttccagttcccgcatccggttaaagagttctttgtgggtgttgcgggacgcctcccgccattccgacatctgcttttccagcatgttggctttctggaggcccaggcaatccctttgcgggtccaggatgcacttctcgtccattttactctgccgcctccgcagtcagcatcttactgagggcgctgtattcctccggggtcagcctgtcggcggcgagatacacgtccatcttctcctgaaggccgtcagtgcggccccggtcaatcagcagcttgcaaagattgtatacagttgtcatggtcctgctcctttcctgtcatacagtggttgtggtgagttccaacatacacaggcgttcctcatggtctgccagcatatcaagagtaatgtcctcggctcccggttccggctccggctgtccatcgtcctccacggtaatctgcccttggtatgcctccgcctgggcgatggcgtaagcctcctctgtataggacacaacaacagcagttaacaccgtctcgatgtccggttcctcaggggtgccgtggttgatctctgttgccaactgatatttgatgatcttcatggtgccctccttaatccgtggttttggtgtacttgataatcgcaacagtatttaatttagatgatgttgctgcactactaaaacttccatttgtatcaatcccgacacgagaagttgttgcatatattgaatcaacaccaccgctcccgacaagatttataggtccactaaatccgctgcattcaacgcatgactcaaaatcagatataccatgctccacacttttagaagtattattttctagcagcccgagactcaccgccttgatgtgtatcggcttgccgttgtaccgctccacggtgcggtactcgacgcccaactgcatggggggatgctcccactcaaacggctgccaagcagacgggtctgacgatgatttttttaattttatcatccgccatccgcacagcgccgtgtctgcactgccgatattggatagcactgcatagttggcgtcacccttatataagagcgatatcgtagtacccgctttgccgtacaccgcaggcggataggccagcaccagttttgcggtcttgtcaggcatcccgtccagtacggcgtctaccttggcgcagtatgtctcataggattctcctgcgctggtggtttcaatgctctgcaccgcatccccaaagccaaaccccgcgggtgccttattggacaaagccgccagtacacctccagactggacaggttttgtactgtcttctgttggtacagcatccgtcgggactgataatgtagttgtggagccactttgagacaactcgatattgtctcctgcttcaatggttaatgcattgacaccattaatagtagctgctggtccagcaggcccttggataccctgtgcgccctgcggtccaggttccccttgtgctccctgtgggcctacaacctggcccaaatcaatctgcggcatgatacagccctcctttaagcaatatttaggtagagatgcccgtcctctccaatctcaaagtcgggcgcggaatctccggtatagtacaagatcaaatgcccattttcgtctatgttgaaagcatattgcccttcagccgcaacagctacgccgctggggccttgagggccgggcggaccctgaattccctgctggccttgtggtccaggctccccctgtttgcctcgcggaatcccgaaagcaatgtggaaagattctgcaaccgctgttttggtggctgtggcgttgctttcaggcggtagagtttctgccgatacggtcatattctcaatggcgtttttggcggtctcagcggcatctttcgcgttttccgcgcctgtccttgcttcctctgccgcttctttggctacgtcagctccctgttttgcaagctgcgcttcttctgccgctttttgagccgccgaaactgactctgcagccgcagcttgcgcaaactttttgattagctctcccttgatactacgcgcctgtgattgttgctctacaactagcaggctatcattatcaagttgggaagctacgggaagagaacctatcgttttgtcagccatgcttcttctccgtttcctccggagcggatagttccaccacgcggcgcagtttagctctaatagctgcaatggcatccacggcgtctccgctaacagtcagtgaggacaagattgcataggcactggatgcctcttcatggattttagtcaaatcggccattcaattttccctccaaatctttaatctttttttcgagctgctgaattttggcaatcgccataatctggatttctccatatcgcagggtgtacaggccgtccggatgctcctcgctgggtagttccgtgcagagcgccgcgaagtcgctctccgggataccttcgtccgccagggcctcctgcacttcctgggcgatcaggccaaagtggcggcgtttgtgcccatcatagacaaaggtgcagggcttcagccggtcaaatacacccaggtatttctccacgtcatattgcttttctgttttcagccgcgcgtcggaggttgtggccggctccccattgatgaataccgtgtccccggtgatggagacctgcgtactggtgcacaccaccgtggaaacgccgtcgtatcccatccgggcgccgttggtggtgcagatcaccactgccgcctcgttgctgctggcaatggcgattcccgccgttgagctgccggatgctgtcatgccagacatatatccaatatatccgccaaatgaacttccactggctgtccggtacacgtccatttttccgcccaaatggatatagttggcactaatttcaccagttcgaatacaacccccagaaattagggttgtcccatctgaaagatcggattcaaacactacatctcctgtgaacctgatagtctgagacgcgactgtgattccattgatttctaaccggatttgagacgatgcggttccgtttgtgacgtcaagcgtaatagagttgactgtctgctgaatctgagatacctgatttccaagtccctgtacagtgctggtaatactgtcaagctggacactgatagatgcagacaacccgtcgatctcatttgcgacttccaggcggatttcttcggcggttttggtgattagggagtgggtttgggcgagctgtcggtttgtttcacggcgttctttggattcataagggtattcatcgtcaatttcgtccgattcaggggcggaaatggttggagcgcaggctcggtcaaataagttgttgatagaggcgattaccgaataatatccgcctaccgtcaccgcgtccccgatttctgctgcagggtccaaaagtgcatccgtcgctgtataaggctgatatgttttcccgctgatagcggccaggatactgttcgccatctcctgcgtgccccatgggcaggttacttcgatagcccggccggtatcgtctccagcggtatagtaatggtcgctgtctacggacaagttgactctgctgatgttggcgggtatgtctcctgtctctagctccccgacgtggggccccaaaaaaaatttgtcagacaaggattctgtcacccccaaacgtgattgcaaagccgttttcctcaaccagataatacgtttctggaggaatgtcgccatacttcactagcagcaatttcccttcatcggtgataatccaattcccggcgttggatacggcgatatagcccagtacctcccgcatggtcaagtcaccgttttcgtccacgggataatccacagggaatgatgttgtcagaaccgttctagggtctacctctacccccatccggtaggcaatatcttctgccgcttcctgctgtgacatgggccagttttcagtatcataatcggagttgagccataccgactctgctttcaacatagcgtcatatccagtaatagtcaggcttcccgttcgcttgtctttcgtcctggtggagataaaaaatacgcctttttccaaccattcggaccgctgttcccccaaggccaaccgaacaaaaacttttatttgagcctgtctcgggatagctccggtcggtagtatttcaaggtcaatctgccgggcggcgcaatttccgattcctggggtggtaaaaagtccgcctgacgtccgaacagagacaatgctttcctgcccatattccacaccagcaacgtccagctttgtttccttgtggtggttcgggttagatagtatttctttatagagatcacttgtaagctgcatcagtttgccctcatctgcaactcgccgcctttgtaataccgctttccgttgacagattttaacccaaaggatgcctctaaattgctagtcaggcgcatggttcgcaccagatcagaagcggtgtatggatcagtaaatatcactgtctgcgtttgttccgccagcgcatcgtaaacagacgaggccaagtcatcgtcaaggggcaaaagagagaaatccacaatcgctcttttgggtgcagaaaacggatgctccacattgtcgagggttgtaatgatcttctgataggaaacttcccacattaccttgtatgtggacagcttcgatgccaaatccagcgtcccgatcttgaatgttacatccatatcatcacctacgttccgtaagcccgctgtttattgcggctatactgataagcagtttcgccgataactttaccgtcaaggaccgactgcaccgtgattgtaaagttctggcccattgtggccgctatgttattaaatgcattggataagccagactgcgaccggcccaacatggaagaggagtagtcaacattagcggttccgaaattcaagccattctcaatgtcgcgccgaatatgactatactcattgtcccagccatcccctagtccaagggccatgtttttgcccatgtctgcaaagaccgtggacggggagtggatgccaagcaatccctttactccatcgacaatcccggagaaaaatcctgttactttgtttttaatccaggttgccatgttctggatgccttcccaaattccctgcacaatgttttcaccgatatctacaatacttcccattagatttccaataccgttcacaatggcagagataatctgtggcaatacagcaaccaactgtgggatagcagatacaatgccggatgcaaggtttacaagcacgctaattccggcgttcacaatggctgggagattatctgctataaacccagtaatggcggagataacctgcggcagagacgaaacaagagacgaaatggagtttataattccatcttgcagagaagtcaaaatctgaacgcccatgtccaagatagatgggagattttctgcaatgaaattcaggattccttctatgatctgcggcaatctggaaattaaatccggaattccggtttcgattccacttgtgaacatagagagcagctgtgtgcctgctgttgccaactgcggcccagcggaaacaatgcttgtgtatagggcagaaacaatttccggaacagacgccgccagttggggaagagcgctgataatgcccgccaccagacccacaagaagctgcgccccggcgctgataagcgatggtaaaactgtggaaatcatttcaggaagcgtctgagcaattattgtgcccatatctgcaataacttgcccaattccgcccaaaattatttttactcttggaagaatattacttagcgcagtttcgacagtgtccgcaaattcatatgtaaggcttcctaggtctccgttatcatttgcaatgccgacaagcagattatcccacgctgctctcatcatcccgacagagccttcaatggttgttgcggcctctttagcagtagtgccagtgattcccatgttctcttgcaccgcatggatagcagtaatcacatcggagaatttagatgggtctaatgcctgtccggtcaattcctctgcatccgcaaccaggcgttccagttcggactttgtgccaccgtaccccagtttcaggttgtccagcatagcgtagtttccgcgcatgagggattggtaagtctgctggatgctctcaatgtccgtgcccatcttgttagcattgtcagacatatccatgatggcctgattggcgtactcagccgccgcctgtgtatccccgcccagagattggatcagagaggcggaaaacgctgtcgcctgctccatgtatgtgtttgcagatacgccagcagttttatatgcgttcgacgcatattgctggatcgtatcggacgcatccttaaacagagtatctacgccgcccacaagctgctcatactccgcatactggtcaatagaggattttgtgagtgccgctactccagaagcagccgcagtcaaagccgctgcgcctacctttgctgccgtagacaggccgtttttcagtttgtcagcaaacgactctgtatttctgctggcttcgtctaggttatcatcataatcacttgtatccagaataatccgggcaaataattcaaacaggttcagcgtctccaccccctatccgtgcgattttttctttcatgttcccgatgatctcttccggggtgcggttttcctccggcttcggtcgaataaggtcgtaatacctgatcttcatataactgccgccggagtattttgcagtattctccgcaaggattttcagcacgtcagttacatagacccggtacgccttttctcttgcgtcttgttcaaaccgtgcaaagacatacctggaaaatgcttttacactccggcctcggtactctcccgcgcagagccagagaaatccccgctctgcgccgagataaaaagcgtcgtaaatgcttcgtcggtcagcagatcaatcgtgtccttgatgagcttgacgaggtttagcgtgcctgtgtatgcctctggagtggtcccttcgatggtggacaagatggagataatgtcgcccttgtggcccttcaggagggcaggagcggcctttcttgccctctgcaacaggaatttattggccgtcatgccctctgggagcttctcccgtttgaacagctccgatgccacttcgtcttctgcaatgttggctatcggatcgataatgtcggcgatcacgtccaatgtccgctcgcccttgatatcagacagtctcatcaggtgctttcctccggtgctgcagagtaaaattccataggcatggtgtcctgtgcgtccatggacacatggccggtcagctccacagagacctggcccttgccatttttggtggtctggagcgaaaatccgccggtggaaagagcgtttttcaggcaaacagcaaccatgccgccgtctgcccggtcaccaacccaccagatatccttgaaatcggtctgcagcagatcccggcgtggagtaacttttgtggtatcgggagagccgatgtccgccgctccgagggccagtttgattgcttccggggacgtgccaagcgccgtaaaactcatagtgcattcccaagagtccaggtgcttcagttccatcatgttcacggggcagttgtccacatcctcgcccatatcggagtaagtgggaacacacgaaatattgataccgccggtagtagcgcacacaatgtcttcatcagacggtgcgtccggtgtggacggatcaaaacttgttagaattacaccggcgtccatctgcagttcctcaaatgtgctctgcgggatgacagtaaatttgcccattttgggcctcctttcagctgaatgtcagatattcagcggtaatgttgatgtaccggcgcttaatggccggatcttcttcgtaaacaacgctttgtgcaaacggagaaccgcgtttcagccagatataaccttcatcgcaagggattgtcacgccgccgtatccgatgcgcttggacagctcttgtgctgcctcgtccggtatcgcctcactctccgtccgaaagaacagattggcagtcaggccaacttctccggcgtcaaatgcggactcgatatactcgtatgtgccatagggcatgatcacatcgtccggaacagaggacgcacggtaaaacgggatttccccctcgttgaaccaggcataaagggctttgttcttggtcatgtggtcaggccccatttctccgccgtgaagtatttcagaggcagcgtggacgatttaggagcaggcttttcctccgggttggaggtcacacggtaggtctggccggtctccgtgtctttgaacacatcgttgtactcgatggggaaatccttgtccaccagcgcggaatataggcttgtgacaccctgcttttccgcgattctggcctccatggaggtgtccagcgcctgatagttagtgaactccgccccttcttcccattgcaccatgtagccgcctgctccatctggcacacgctttttttccatcagcacgcaggtgcgtgcaaaatcatcaagcaaagacacgttctcacctccacgggttgtctttgtgcggctccggcggagtcatatgcgggttcgggtttgcatactgccagcttcccgccggtttcttccagggggcaagctgggcggcaaacacgtccctccagcccacggcaacgccctttgagtttgtggccttggaatagctgtacccgccgaaactctccgacgtgtacgccccgccatccccgtttttggccgtccaggcggtaatttcctctaccgtggataacaatgcttttggaatggccagcgcccacacagagccggtaaacgtctcatcggtcagctccgccggatactgataaaccccatcgttgaacaggctccccacaattcgaaaatactgcccatttgcgaggaaaggcagcgtaatgccgccgtcctcgatgatgtatgtatcgtcataccggcccacggcgaaccagttgttcagatacatcaaaacggtttcaagcatcacgccgccctcctatcactttctcgatctggtttttgcttttgcctgcggttcaaatgttaccccagagaatttgaatgtcacaacgctggcatcgtccacaagcacctcaaaggtgtcattctttgtcacccggaatacaatgtccgggtcaaaggcaatcttgtcctttgtggtctctccgtttttcttgaaggtcatattggtcccggttttggtcaggtggaaggggaagtaatagccgctatcttcacctggcaaactgctgaactcggaatacccagtcacatagtgaaatgtaccagttacagaaccatcggcttttactgtcagatcatcaccgaccaattcagatacctgtttccccaatagggtctgactgctggggaagagcgttaaagtgtcagacccgattaaccccccgccgatacggtaatcttggcaatgccatccagatattcagcccaaagcttcatgcccataatggcgtagctctcgcccacagcggtggagtagttgccctgggcgtggaacccgatcaggttggtctcaccctgagtggtgtagttcaggcccagccgggcaaactcgctgtcgccgggatcgatgtagtacaggtcgatattctccacaggagtcgccagaaccgtattccgggcaatgccagagccgccggagatcgtggcgggcagcaggaacagcgtggagtaacccatgaaattctggatgtagttgattccaaactgggtctgcaccgtgatgtcagcagtgcccaggtagtcgtaagcatcaagaatattggcaaagccaacgacctgagtcacgtcctttgccattccagcgaacttgtccagcaccttgccctgagcctgggcaagagcggcctgccaggtggtagcggtgccggccagagaaccggtgttcaggaaggtgtagaagtcacccagcaccacgttctggagcttagtcaggaacgcatcgtcggacttctccacggcgatctccgcgccgtacttgtccacatcctcaatgggcacagccttggcgtacttctggatggtgatgtcatccttcttggcctgtacgatggtggtcttggaataggggattacctcgccggggcccacttcgccatcctctagatccacgcttgcggtgtaagagatcagctgagtgccgggcgtcttgcggataggccgcataatgcccaagatgttccgcagggcctcccagttgtcattgaaccgggtaacaaagtccacctcgcgggcggtcacggtggtatatacattggggagcgaatcgcgaggggtagtaaagctctcaacattggtagctgccattcaattcagtcctttcaagtaatttgattttccatgagcgccttttgacgctctgcggcggacaaaacataccgtccatggtcatcctttttgtagatgtcggcctttgtcattgcaccgctgttgttgtttgccgggggattggaggtctgcgcgcccctggtctccgtggtagtaataaagtccgcccactcgctcttgatgctctctgtgagcttgtcagcgcccttgatggcccccttgtcgtccagctccacgctgtccacgtcggagaccttcaacacggattccaggcgcttctcgcttaccccggcttcttgcaggagcgcccgatatgccttttccttggccgcgcggctctcctttttggtctgctcggtcttgtagccctcgaattcctctttcagggcctcatacttgaccttgtagctgtctttctttcccgcttccagatccgcctgcgccttttccaactgcttctgtacttcgggcagggcttctgcgtcggccttatacttcgcaacgtccgctttcaggccgtccacggtctcgctgtgcatggaaatgatctcgtcgatcttttcctcgtcgatgcccatcgctttcagggcacgtctggtcagtgccataatcagtctccttttcttcggccccagtacttcgggggcgactgtgatataaaaaccgctgtactttgcgggttttaccaaataaaaaaggagccaacctgcaagaaacccttacaagttgaccccaacggtccttcccgctcaccaattagagcagggttcagtgtttacttttctaaaaattcatcaagcacccttttcaatattgaattgacgctggtcccttcttcctttgctttttctctcaccttgtccgcatattcctttcggaccttacaccctaaaacagtcatgtgttcagcaatgtatttgttattcgctcttttctgtgcctctgtgagtgccattgtaccacctccaaaatcattttacatgattttatatggtttaacaatgtacaatccgcacaatatatatggttaaactttgcgaaatttgccgcttgaatatatggttaaaccatgttatattatactcacaaggaacaaaccacgacaggccacaggccgggagggaaagaaaatgaaaagagtgcgcatgacgcttgatgaaattcgtgccgagtctacatactacatagagacacatgacaaatccgccggcatatgcacattggttgatgttgagaacatgggcttttgtaaagatggtgttacccgttggtatcatttcacaaacgacgaggggcaacccgctgtatattacaaatactgaaccacaccacccgccccggaggtcacgagggcagaaagggaaaaagatgaacaacacgagatttaacaagttgtgggatttattgcacaagtccggggaagtcaagttcgctgattgcaacgaatctctctcgctatcgctcgtcccatccagatatgggtatgaagtttctctgcgctctggtggaagcacggttcttgtgcactatgacaaagaaagatttcgtgaaatattagttgactaatgcctttcttccgcccctaaccggggcggttttcttttgcctggaacttgatttcccgcttgtcctccagaacgatgtacccatctcctttttttcggactacggcgtcgtttcctttggtaatgatggccttgataatggcccatgctttttcatccatttttcagttcatcctctatgatattccggtaggtctgcgggtggtctgccaccgccggtttcaaaaacgggtgtgcttgattgccccttgtccaatgccagttgccctgtgcgtcctggtacacccacggcgtgggccgtccgcctccgccctccgcataaatgccggtgcctaattcctggtaaacgccgtattcgacgttcgtcccgacgtaagcggccatttcatcttcagaaactgcgtgtgaaatgccgtttctaagccgcccagtgtcaaccggggcaaggtcctttgcatacccttccgcctccatcccgcagcgctccaaggcccgcaggcaagccgcgcgaaacgcttctcccacctgggcggagttgtttacaacgtcaattcgcatttcgctgttattcgccacggcttttcacccactcttcccattcggaataggtcatttcgttcaccaacacatagcgcccatccggcccttttactcgcatttgacgaggttctgcctctattccctctttttcgacggttctcatgctgcaccggcagttatacagatcaccgggctttgcgccttgcgggtctcccgggaacatcatttcgctccccaggtcagacacaaagggcttgtcatagtcaacggttttcccgtccagcatggcgtgactgtgacgggtcctgttatccttagtcgctatccaccgttttctaaccttgatccccatcttagccgccgccacatagctgtccatcctcccggcgttttccgcgcctgtgacggcggttctagccgctctcacggcgcttgtccggttcatgtcagatatccggttttgcaggtcatcagctatcttcttgatactgctgccctgtaagatactgcttgtgacgcttgcggtgatctgctgtttcccataggccaagtcgataccacgcttgacagccttttccggcggatagtatggcatcaagtctggttcttcgatgatcaatcgctttacggtctgttcgtcccatagtgtaaaccccacatcacccgccgcttgttcaatcgtgtatgcggcataatttcggttcaaggagtagatcccaggcgtatcatcattgacataagctattgcggtttcgtttgcctttgtgtaccgctccgcaacctttgtggctagatcatcaaaccgttctccacgtccgatctggtttaagcgccactgtttataatcttcttctgtccattccttaccattttgaacggttccgatcagctttttcatctgttcgtcccgttcttggaagcgttcaaagtagtcgatgactgttttttcaaggtcatcccaggcttcccagtagaccctcgctattctccgttccagccgttccagttcctgatccgtccactggtgccccaggtctgttggcattattcgtcacccccagcctgtccattgcttcggcatctttccgctccaaaatgtcatctacctcatcgtttgtcagccaaggcaaatgacggagaatggcttcagagtccaaataagtagccgcagtcatgaccatctgcgtttcttcaagttggtttgcaatgcggttccactggaaagacggcgtgtcgtcaatgtcaagcaaagccagcagcttcccgataaagtcccggatgtaatactcaaaatctccgcatttatcgtcttggctttgatatcccattcggatggccgtggcggtcaggttcccgctcatgatcttatccatgtccacaagctggaaatcctcgtacaggtcactccgcagccttgtaagcatggcctcccgcgcctggtatggaacgtccagtgtatgagcctctgccccgcctccgtcgtcgctgtccaccgttgcggctctcaatgtccgcatcctatcgaggaaccgggcgatgtctacgtcatccatgccgccggagtttttcaaaacccagtaaatgccgctggaatcgtcaatttcgttggcaagcccagacttaacgaaatcgtaacagtcaatggactcccgaattccaaccaactcactttgacgaagatcattggcatacatgggaatgatcggaaatccagggtaattgtcgccgctctccacagtttccccgtccacttctgaccggcggatcgtctgccgataggggcgcttgtcttggcttacctgtatgtcttcgcctttacgctggatgtactctgtgtatccgtccagctcatagagggtataacgtttcgtttgtgtctcttccaggctccaatagcgaattccggcctttagaaaaccatcgtcctggtcgtacagcggtacaaatcctggctcattcggagtatcagcgtagctaaaaacttcaagatggtcatagttccagaagccaaacgccaccttgtccaccatggctttcttagccatttgggacagtctgctatcaaatgtctctccaagccgctctttcgtgccatcctgctcgaaggtaacgccattagaaagcacatactgcacctgctgaatgacaaaccgccgaaaaaacagggtttttagcttgtagttcgcagaaaacagatcaggataagcctgcccgttggctttgtacaggaatttctggaacttctcaatggtcaggttgtgctttgcatagtacgcctccgcagcagcggcaatcttataatcatcgctggaagtatggtcctgaacggctccccgcacgaattccatgcggtctttttcgttctcacccaccgccagcaggtcttgatatgtcctcaacatctcacctccgtgcataaagaggtatgtaagtattttttgcctgttgcccaggccgtctccagattggctccgtagcatagcggacggcgtcaatatggtggttgtctctatcaggatatccgctgataatgtcgccgtctttcgtccgctcgtattcgtattccataaactcctcgcaggtatccggacagcgctttgggtcaatcacaatagatttcagggattgcagccacttcatggaatactccacacttccaggccctttaatagcacccgtgcagtgcaggccgaatttcttatagtccgctacacttttcggctccgcgctgtctgcaacaatgcggtcctctctggtcaagcccttttcaaggagtagatttgccgtttcttggttgcccatcttgtttcgagtcagctcatcgaagatatacagcacacgccgtgccgcgtcataatggcagcgattgaatgcccacgggtccgggaaatatccccagtccacgccgttgcaaatccggtcaaatgcggaaacttcttcgtctgtcagctctcgaacgtcgatattttcaaagacattcccgcccgtaccaaccggaatcccgagatattcatgctgatatgcccgctcgtccgtttctttgaggtattccgcttctcgcaggaactgttcccccaaccactctggcggggcttccaagtatgtggatttatgacacagcctgtccgctctctcttcaaggctatctttgtttgcccagttgtcccggctgatcggcgggttgtagctctcgaagttccagaacttagagccgccacgcattgtggattgaagaatggttcggatttccgcccgccctgcaaactgatccttttcctcaaagtgggtgacggcgatatatccgaaaggcaccttgatagacttgatcttcatggggtcatcagcgccacgaaacataatcttctgtcctgtcggcttataaatcagttccatcggctggaccttagcttcccaatagtccgccattccaagttcgccaatggcccacagatattgagcatatacgctgtctcgaatggtgtttgcaaccttgcgcaggaccagcgcatgtgtccctttattggtcagtagaatcaacggaacaaggagcgaaacgcaagatgacttcagagagccgcgcccaccagacagatcataatgagtgtggccatgttggaacacatctcgagcaagcaagtggaacgctgggccaaggactgttgacaatctgatttcagacatcgattaccaccttaacctcgtcctccgttttactttggtctcccagcaggtcaaacagcacctttgccgccttggcgtctcctttagcggccttgatggacagcccggcgatgatcgccatttggttgtccacatcctctggggcaacgccatctttggctaatttgttccatgctcttttgtcggaaaccggcagagacaggtataattccgccgcttctctcaggcttttcttgcgtcggcgggcttcgccggatgcacgaccgccttctcggcccagctctctggcttccttctggcttctctggtccatcggtataaggttctgttcattcggcatatcacctcacctacttcaaatactcttcaaacagcctcctgaacagcactctggcctcgtcagggttatctcgtgtcctttcatccatcccagaaaatccgcccacagcgcgtctgagcgggctttacgggcttccaggtcttggtcaaactgtcccggattgtatccgtacttgctggacacttctccaatacgatgacgctttatctttgtttgcatccccgatcccgtccctcccatcttttcagcgagacaggcacgccctatttggcgccgcatggagggcgcgaccctccggccctgatcgtgggctgatacgctcgtgcggcatatttgaagggagtcccccggcaggaaacgtacaagagaggtactcctttccgtttaatatctgctcactagataccctgccgggggagtgggttgtcctttgggccgtggttggtcacagcccgaaaggggaggaaaaagaaggagcatggggaagtcactccctcatgctccattgtcgcataagttcaactggcaattcctcaaaaaggaggaattttcaaattttcttatgagacgataaaggtttaactacgcatggatagtctgttcgtccaagtaagtaatctgttgacacttcaaaataatcagctattgcctccagagcgtccgtccctggttttctgttcccaagttcataccttctgatttggtcagacgatatcccgcacagctcggaaagcttgtatctgctcagcctgtttctttcccttaaccgcctaagccgttccgggaactcattcaccgggcatctctcctttcctgtaccacttcatgccggcgcatcgccaagatgtattgcaggccacggatatttgactcctggcaactccaagggcctctgcggcggctttttcagacgggtattcagtaacggtcccatcattgctgacagataccaccggcttagctggcatcgtccacctccgccaatgcgttaaactcgtctctgttaagcggctctgtcggtctttcctgcggtgctaatcctcggacccgcaacgccgttaaaatcgcatccgtgttaagccccaagaaagttgatagctgccgcatggagtacccctctgcgcgtttgagcgatatccactcccattgcgcatcagaatacatatcaccagggaaatggtatctacgaaccatccatatcctccttcttaatccaccaccgtcctgctccgcttcgatgggggcggagatgcgggtccagtcaggcatttccagcacctccgatgatctcgtcaagggtatatacatgacccttttcaacagacgggaacagatgtctggtgattacttctctctgaaaatatgtgccgtctacaatttccaggcactgcgtccatgcaccatcgtattttattgcattgatctccgggagcaaaactttgattgccttcgccctctccacctcctgctcggtgaagcggggcttgcagatgatgcaatcagcgttattgataatgtaacaaagttctccggaggtcacttctccaccatgtgcatttctgatctctccatctgtaccgacaaaataacttttcggctcatcaaatgggaagtcattaaactggaagttctggtttacctcaaccccagcacctcgcaaattctcggtttgtccatgttggcctccaaactttcacctttgctatcattttttgtaagtacatttccatcttccaccacctcatagcccatcaggcgagcggcttcgtgagggttggctcttacgtattcatgacacggcctctttgtccctgcgtattgctgcacgggttcccgaatctcgcaatagtcgcaatcttctttgctatcgcaaaactgcgctaatgcctgttcaatggtaagtgcgacttcgcccgtcttactccgaaacttcatggtcggcctccttgcccatgcgggcaccacaatgacaatatggttcttcttttagctcctctcttccgcataagctacaacgaaatgatgtgtattcatggagaataggatccccattctggtcatattcaactggaatatatgtatgatggatttctggattccatctcccgtgtcgcaccggggcaacgtcagcggcggggatgcctttgattgctccgccaatattccaagccacggtatcgccgcaatagtctgccattctaagccgatcttcatattctttctggcagatgtcgagtgcttccgccctctcgatgtactccttcattctctccacctctgttcgtggtcgtctgcaatccgtttaatgatttccagctcttcatccgtcagcgtccggttccacgcaatggaaaaatcgcccgtacaccgattcgggcaggccgtacactcgcagcggttggcgttgctggtatcattcaccctgaatgggcagctgtggttatagcagtcagttctaatccctaattcccgttcgacaaattcagcgggatacatcggcggtatagttttattctccatcctgctcctccaatacggtcatatcatagccgctctctataaatcggatcgttttttgatggtcgcaagcgttcccgagataagtgtaaatctctcgcatatcctccacactgaacctagtgtcaagatattgatttataccattcaggaagaaaatatgaagggctgtattatctactgcacggcgaaacggcgtggacttacaagccgcgcgggaaaaccactccaacaccttgcactttacatccagttcgctcttgcaagtgctgatattgaaatacacatttgccttttggtgggcgataaactccccctgggcgttgatgaaccatccagggaaggaaagcccaagtctcctaatgactgcccaatcaaccatcctgctccctccgtagtgcggcctcctcgcgggtcaggaaaacggttttaccgctatattcggtgttgccaattttgagccgccatttcccgccgtcaaagtatgtcagccgcttcatgtcagtcctcctcatactccgggtgtacgcccatgcaacagtcaaagcaaatccagccagtgggagaacattcatctctcaccatctcgctctgctcataccgttccccacagataccgcactttcggtagtatttacgctttttcatgtcagccctcctcgccgtcccacttccatgcggggcaaagtttgtgcaggtcctctactgccgcatccctctcccgcttcatctgatctctctgattttctacaatttcaatacaccgcttcacctgttccagctcggcccgcagctgctcgttttcggcccggagcgtggagagggtggtggcgccatcaagtgcaacgcctcttttcaggtccttcccttcaaaatatccgtttagctgctcaatcagcttctcaatgtccatcaggtgtccacctccactggttgcttcatccacttcaatgcagcttgcctgcacccttcataaatcggaatgtttggataagcacagatgaaattgcatactccgcctttttcatgctcacaacacttacaaaagtcggctctgagaaaaatgtccgccagttcctcgtcgctcatggcccggattttatctgcgtttgtcatgtttcatcctctccctccggcgggcggcggtaaaacacccaatgcgggatttcctttacattgtaaatgctacctgcaggtgtgatgatatgcccatgctggcacagacaccagtacccgttcccgccctcgatgggtttgcaggcaacccacacaggctcgtccatctcccgcagttcctccagcgtcagcggctcgttcggcggggtgagggtgggcgtgaagtaatcacacccatccgtacagaaacagcttgcgttctgcgattctcggctcgcccacagcgcacataccttttcgtgcaggcacttcttgcaatcaaactcttccatctttcagcgcctcctcagtcgcaatcatctcgattaccggaacaacttcaaagtctctgtcccacgaagaacagccgcttctagcctgcgcctcagaacgatatgtcttgacggatacgtcttttatttcggatatgggacgaaaactaaaagcctttgctagaccgcaccagacctctgttctgtttttccgcatgaccacatagcgcttgcgctcaatccgcatcgttcaggacctccatccttttcatcaccatctccacttccatcttgatcccctccagcatctccatttcctccgcgctcagaatcggcgcgcgggtgttccaggccaggcgggcttcgtgttccgtcttataccatccgctgttcgtaaaacatttcatgcagatcacatttctgcggacatttggctgatagtaacgttcgttccgcacccttgcctgtcctctgcacataggacatggcaccagcacccccgcatccgtcagccgcttcgcagcatctttatttccgagcatggctaatttgacgtcatccattacaaattcctccccattgttctgccattgcctgagctatgcctggaaaggtcttggcccgattcttctgtcggtctttcccacctcgcatgaaccatgttccagcttcgtgacagctgcatttcgggtcaacaatgttagttggctccaaaggaggaagtcctttcaaccacaggcgggtctttttctgaaccgggtgtccgaacatccacggctggacctcctgggtgtgcggcggcatttcataaatcttgctggatactgggttctccacacagatgtgcgggcagtcggcattcagaaacctcaagaaaaatgcttttgcctcaagccctgtccgatagcgctcctgattgagaacgccccccttgaacaggtgttttgctccggcgttcgacagatatgtacaaggcggaaacgccagaatcatgtcccactgcattttcagcatctccaacgcgtcacattggatgtgccactcaggatggcctccgctgcacggctcaatgtcgcagctgtatgcttcatgccccagcgccctgaatgctttgcacacttcctgagactcttcacaagccaccagcactctcatagcttcgccgcctctttgtcgcccagcagggcgcgcttttcatccgtcatagtcctaaatcctcccatgtgatctgccgttcttccaggtcaaacctggaccccatgtaaatgatgttgtcatctgtccggaaccgcccagggaaagcaacgttttccacgtgttggagctctaagagcttatcccatagctccctatggtgtgcccgcaaatgtcggaactcattgtcactggtatttgggcagaagaagcacccgccacgcttacagaactcataggctggagagaggagcccgtatttccggcagagttcgcgcgcatccttctgggtgtatccgtatttctgcagcagggatattttctgcccgcccaggcgcagcagtctttcgtcctcgtctgctgcatatccgatatactgtactgctcctttatgcgcccggcgaaaccggcccagcggaggtgtcttacagcgatcttgcaccttgcaaaaccccggcgacgggaatccttgatactttccggcccgcaacccctttttgatctggtgccaaaacacgtccataaacgtcttttgagatcgcagaacctccacgcgcacgccatgttcctcaaaccacgggattgctatcccgtggataaaatctgcatgttccgggacctctccgctggtatgcgcatcaaacatgacctcacagtataccaaggctgtcaaaggctccccgtgctcgagagcaagcagggctgttgccgtactgtctgcgccgccggaccatgatgcaaaatgctcagtcatgctctcttcctttccagcgggcggctctcatgcttccacctccgacggatagactgcgtactggcccttgccgtaacgctggtattgggacgccatccgccggaaggactggtattggatgcccagatattccgcacactctcgggcggtgccctcaaaggcgtattgcccgtccttgccgtagatggtgtacatcttcaggcagtagcgacgcggtatccgcacacgcccatatttccgggcccagatgctgacggtcgaaacggacacattgaccgctttggcaatgtccttctggaggcatccccggtccaccatctccagaatggtttgcagcttcttagttgtcatgacttgcctcccattcccggtacagggaaaaccagtcctccgcccgcatcgtcaccagccactcgcagcggctccgccggtgggctacaatgggatattcccaaggaggcgcatcgtgcttggcctgggccatggctgcctccaaatccagccgctccacacgcttgacttcctgatggatgccgggcagccctacaacgtcagaggcgtccccggtgttcccgcaatactgagccgtgcggcggcagtcatagccctgcccacggcaatagctggcccattccagctctccgcgcttgcctttttgtttgctgttcatggttcctccttgtggtgatacatttcccggatgtacttccacgtctcgtcgttcatgctttgggcagtaggtttttccttcccttcctgcttcctgcgcttttcccaggtgattacagcctgtttccagtccttcatgggagactgaccgatcttccagcccttggaggcgtagaaagcaacaaacgactctgggtctaccccgttgttccgctcctgacaatatgccctgacttcatcgactgtcggaggtgaaaagcgtttccccctggaagagggggtagggggagtataactatcgttctcattctcttcctctctctctacctcaccctctacctctatctctccctctatattgctttccgtttgcttccggtttgctttcggtttgcttccgcctcgcttcccgtttgctgcctttttgcttgctttgtcaagtatcggttttacaagcaaaaaggaagcggatgcctgtcctgttaatggcttgctttctccctcgaacacataagtacaaatcgccgtcacaaagggaagctggtccttcttcggaagcacttttaacgcctcccagaagctgcggtaaaaggtaaattggtcacgttccaagcagttcacccgccttaaaacggcagtttgccgtcctcttcgccgatctcggcgaagtctgcggctgagacattgacgccgccgctctggatggggaagtgggactccttttctgtgggccacacatagtccgctatcaggtctgtataggttttgccgttgtactcccggctctccagccgcccggcggcgatgacccggtcgcccttcaccataacggacagctggcgggccagatgcccccagcccttgacagtcaggaaagcggcggttccgtccttgcggccataggcccggacggagatggagccgacctccttgccgttgctggtgatgcggatatcgccgtcacaggtggcctttgcgatgacgagtccggtcttgacctcgttgccgctgcggtcatagtccgtaatgccattgataaacatcaggagtcctccttttgcagagcgtccaccagggcgtcgaagtcgccggacttgatcttgctggcgctgtcgtagccgtgggagcgcaggaagtccttggcctcctgtttggtaaatccgtggcggctggcgcaggtgtagaagaacttgacctgggcgggggtaatgggcttttccgggtctttgtccgcgaagtaggccccggcatcctctgtgtcgctctcaatgtcctgagtgaagctgtcggacatgcatcccagggacagggcggcggacaccagggcccgcttctgtgccatcttcagggcgctgttggcgccgtcgtagggggactggctgccggtgcggccctcccgggtgttggcggagccgtaggagctggtaatgatgtactctttgccatccacgatcttcaccaggtcacagcggacggcatagaagaagaatccagtctcctggttttcgatcttgctctccatgtggtatcgctggcagaggccgtaggctacagcaactttttcggcgcctgccttgaacagggtggggtgcttcgtcatggcctccccgttcttcttgcggatcacgccgaagtcgatgccacggcgtagggtctccggctggcagccaaacacggagatttcatagtccccggtatggggcttgcgctgcaccgtcaggggcgcggcgttatagctgtagagcattatttcttcactcatgcgtggttcttcctttccactgcctgattcatgaacagacagattttcagcagttccaggtcatagcggacttccgtgagctcataggtcccatccttggagagtttcagagcatagagataatccggggtactatgccatgggggcatcaattcttggtaggctgtcagctgggcccggagagatgggccgtggagttggccagtcttgatgtccaggatacagctgcggccatcatagagcgtcccgtatcggtccagcgttcctgcgtaaccaaattccagattccccatggggtgctcgatcagctcccagtccgggcggtagtctttcaggaagcggcggtaggctttcagatacccggcgatctccggcgtttcctccggtgtctcgccatagtcgatcagggcgcaggcttcatggacggcggtcccccggcgggcggcggtctccgccagccacggcttatccgatttgtagtcgtatgccagaaagcggcagatgtgggtaacgctggggagttccacgccgtccagggtataggtatgggacttttcatcaaactggatcaccggaactcgctcctttccttgatgctgcggccgtccagccactcgtccagctggtcctcttcctcttcccggagagtgtcggcgaagccccggaaacgggatagaagggagcggcggcaggatttgcagaggatgaccccagcgggcatatagtctttgcagatggggcagacggcggcgtcctcgatataggactggccgcagacgggacacagctcctcccggtagcggtagccggggaatacggtggggtccgtgccctcccggaccataggggcgtcaaagtaggcattgcagatttggcagtgcttcatgactcgcccccgatccggaacgcatcttccgcgggaatacccatgagacgagccacactgtcccggaatggcttggaggcagccaaccgcccggagagcatctggtatgcctgggcgtatgagacgctgcccacgtcctgaatgaagctcttgaccacgccgccatagttttctacaatgtaccttcggatgaccggatacagcacggacgggggccggggcgggattcggatgcaggccgataggtcattcttgatggtgcagtccgcgtatccgatttcccgggcgatctcctgccagttgtggccgtcgatccgcatcgtgaatgccttgatacgtttttctcttgtcaaatagctccctcctcgatgaaatagattgtagcggtacggactccggcctggatggcggcctcgtggctctccatgcagaggtcgatgtgggcgcctttcacggcgcttccggtatcgtccgcccggtaatagtggagttctccgtctccgtagtccaccaggacatcagaacccaatgggatgatggacgggtccacggccacagagacgccgggcgtggcccttctgccgctggcggtgatgccgtcggacttgccgcagcagcgggagcaggtgcagtagtgggtgacggtgacatcatccaggcggacggcatgggacagcagcgccgcctcgatcagctcgttttccgcggcctcctgctcctcttcggtgagataacagcggaccagggccggggtatcgtcgccgggtaggctgccgtcctgcgtggcgggctccggcttgtgcatggcgggccgatctgctttcaccgtcataatcaggtagcttcccagccacgccagcagcaagatcagaaataggagatatgtaatcagctgccgcctctggctccggcgccgccgctcttcgcgggtcagctttttcataggatatgcctcaccgcttcttctcgggtaatatagaaatggatgcccgtgctgcactcgttccagcggttttcgtcgaaatccgaaacggagaccacagttccgggaatgtaatggaagttctcatctctatcactgacggcgacctgctccaatacaatcccctctaaatcctgaatctccaaaacggttgcctttgagcagcggcacttccggcctgttccggaactgcgcacggcatcttcggtaatttccagctttacaatgcactcatgaccgctggttttgacccttgcctttttccagccgacaaaagcgccgatttccgggcaggcaatgggataaaataaattttttgccttttcaatgtagtcggccctggacaggtcggccctggacaggttggccccgaacaggttggccctggacaggttggccccggacaggtcggccccggacaggtcggccctggacaggttggccccgaacaggttggccctggacaggttggccccggacaggtcggccccggacaggtcggccccggacaggtcggccctggacaggttggccccgaacaggttggccccgaacaggttggccccgaacaggttggccccgaacaggtcggccctggacaggtcggccctggacaggtcggccctggacaggttggccccgaacaggttggccctggacaggttggccccggacaggtcggccccggacaggtcggccctggacaggttggccccgaacaggttggccccgaacaggttggccctggacaggttggccccggacaggtcggccctggacaggttggccccgaacaggttggcccgttttccgccattttcgcctcgtagccatttaaagtgcttgtccaaaatatttttcaactcttgttcgtccatgcgttattcctccttgtaggtctcccggaagctgccttcggggaaatcgaactccacggtgaaatgatggtgccgctcgttgatggagactacccggcagggatgcgggcctgtccttgcggtcacaaaggcgctggtggggatggtgggttccaggcacagcttgtctccaatgttcatctgtggccctccagtctgtccagtatccagaagagaccgtttgtcagggagatggctccagcggtcagaacgatgatttgaaggatcatttcgacacctccgaaagactccgggccagggtggcggcggagattttggagccgttgaaggggaagcggttcttcaaagtgctgtatttcttgatgccggtgaatcgccggacatcctccagggacagcaggtgccgcccttcggtgaattctagaatgtccgcgaggttgtcgcggtagtatcttgactcagacattcgggtcctccttttcttgatggtcgtggttgctgttcgggtctgacgggcgaaggcgcagagcctcgtcaaaggtcatgccgtaggccgcccggttaagcttgtccatcagatgtttggtgttgcgcgcctgggcttccaggtctttgatgctgtctttttcgttcataaaaacctccttgtcatttgacccggaggcgtgtataataacctcgcgggcctgttggtctactcaataggttccgcagccctcgtcggtgtcgctagcactggcgggggcatctttattgtcctttctccctgaatgtgataggatgaggggagaaagggggtgagccttatgtctaatgaaactctcaagacgtttcctgatagctatgcagaggcacttgcgatgctttatctgcaaaatcaagaccttagagaaaaaacaccgtcagaaattcatactatgtatcaagaagcgtactatgaaatccttaaagaccaccgaattaaagctaaatctggatggttcaaggatttaaaagcaactgactaatgctaagcattgcattagaaagtgctaccaagtcgctatctgatatgcacttcttggaacgctcggaaagtagttgcagctgcttttcgagcgtctctaatatctgctgattgtccatctctctcacctcccctcacccttcgccctgatccgaaagaagcttgtctacggtgacgccgtagagctttgcgattgcagggagcatactagctctaggaagtgatccgccctgttctctctcccaaaggcaaacagcagaatcggaaataccaagtctgtccccaacttccctttgtgaaagacccgctttttccctgcattccttaaatctcaaaatttcacccccaaaacgcttaatattacttgacatcttgggctgcaccgcttaatattggattgtcaggacaatagaaaacggtgcaagcccaatattaagtgggcctggttttttgtggcttaatcacttaacaatattaagtatatagcattggcctcttaatgtcaagcccttattcttaattttattaagtgattttgaaagggactttatggacattatttattttctcgctcagattgataggctccgtaaagagcgaaaaatgacaaaagcagaattttatgaaaaggctgacgtaacagcatcagcggtctcccaatggagaaacgagaaaactgttccagcagaaacgaccatccaaagaattgcagatttgttcggagttgaagtttcttttctgactgggcaaaaagaaatcccgcccaccgaaaaggtagacgggatggaagaagaacttattcagattttccgcttgttgcctgatgatctgaaagcgggaattctggctcagataaaagccgttctagttcagcgtggattacttccatcgcagtcagaatagcggcctccttgtttgtgcttttgctgataatctggatcaggtctttttcaaggttcatccgacattcctcctttttgtttacaatatatgcttaacgttgtgtcgaaattgcacagaagcgtgcaacaaaaataaaattttttagagagagggaaaactatgcaatgccctaaatgtggaagcgaaaacgtcagcgttcaaatggtaaccgaaacgcagttagtagacaaacatcacgggattatatggtggatttgcattggttggtggtggatttttattaaatggcttgtgtttacacttcccgctttaattgtaaaaatttttgcgcccaaaaaacaaaaactgaaacaaaagcaaaaatctgtgtgtgtttgccaaaattgcgggtatcattgggaagcataaaaaaccgccgtcaggtctcccctggcggcgtacttataagggggtgtctttttgaactgtatacgttgcaaagcggagttgcctaaaggggcgacatactgtcctgcctgcggaaagaaacagactggcactcccccacggaaggccttgaaacgtgcgaatggcaccggaacagtttataagctgtccggccggcggcgccgtccttgggtagctgccaaaaataaagtaatcatcgggtattatgagcgcaaaacagacgctacagaggctctggaaaaactgtctggtcgggacttgtctgagcggtacaacatgacatttgccgaggtatttgaggtgtggaaagctgagcattatcaggagatcggcgaaaaaggaattgagggatacaatcgggcctttgctgtgtttaccccgctccacgagaagaaattcagggacctccgcacagcagattttcagttggccctagacccacacatgcagaaatcgcactccaccgtgtcaaagtacaagcagttgattacgcagatgtcacaatgggccatccgggaggaaatctgcaccaccaactttgccaaattcgtccggctcccggaaaacgtcaaaaaagaaaaagacatctttacagaccaagaaatcgcaaaactggaagctgataacagcgaaacggcaaaaatcgttcttatgctgatttatacaggtatgcgtattggggagttgttctcactgcctcttgcggactaccacggtgcctatgttataggcggagaaaaaacagaggccggacgcaatcgcatcattcctatccgtctagaagggcgcggctattttgcctatttcgcccaacaggcaaccgggccactactcctgtctggatataccggccagcgccgcccggaaaactaccgcaaacgggattactaccctctgttgaagaaactgggcattccgcagaaaaacccgcattgcacccggcacacctatgccagctgggcaagaaaacagggaatggctccggagaccttgcaaaaaatcctgggccatgcggattacagtaccacagcaaatatctatgtgcatacagacgcagatgaattgatacaggcagtcgaaaattgttagaaatttgttagtaaccgaaaaaagtttttaaaaattttcctcgatttaagtttcgattttccttgaaattactcggtttaaccattctacaatgttttgagaaagtataatactatatttcacacgcaggaggtcactggttcgagtccagtagtctccaccaaaaagttcctgatttcgcaagaaatcaggaacttttcttttgcctcaggctctaaaagttttctccaaattttctactttttctccgaccaatacactgaccaattcggggatagtttcagaagggacacagctccgggcgaaatgattttgcctagtggtgtcgtattttgttgttttatgttctaaaatcggactttctgcgcaaaagtttcttgtagataacaagtcgaaatgttatactaaaaataatttcaaaaacagagaggagtatccatcatggctgcgccgcgtgtttttattagttcaacatattatgatttgaagcatgtccggaatgatatcggagattttattagatcacttgggtatacgccagttatgcatgataggggcggtgtagcttatacgcaaacagacactattgaaaatagttgttatagtgaattgaccacttgcgatattgtaatctgtattattggaaatcattttgggactcaggcttccacaggcgatttttcaatcaccatggaggaacttcgcacagctatcaagaataaaaagaaaatttatattttcatcgctaaagatgtatatatagaaaaccggacatacatgcaaaacaaggattcgggcacctttaggcccgcatatgcggataacattaaaattcatcagtttattgaggaactgcgtctcgcaattaaaaataacccgattgaatctttcgaaactacaaccgatattgttaattccctaaaaagccaatttgctggattatttcagaactttttggctagggatgcttctttgacagaagctaaaacagcttatgatttacaggaaaccactgaacaatttaaagacctcctatcttcttttcataaagaaaccgaaagaatgtttcagttttggacggaaccttttttacaaccaacaataccatttactatattcgatctctgttgggtatgaaaagttccacctttattgttttagaccaatctgggttggaagaatttctgcaagtagttggattttccgatgatattgcagctccggatgagtcatattggagatacaccagagtacatgatggtatgaaagaaacaattacgcttgatttggatctatttgatgataattataaattattacgattgccaatgtctcgggttaaaaccctgattcagtgggaaacagaagatgcctcttctgttcaagatgatgaattgccgttttaatttctaaaaatgcacctttgtgagtgtatgtgctcacaaaggtgtattttcatattgccttccctatcacatcgcccatggtatccgctgcttctcgcatcatatccggcgtggcgtgggtgtaggtgctgagggtgaagcccgcgctgtaatgccccagggtgctggacagggtcttcacatccaccccattcttgagagacagcgttgcgaaggtgtgccggagatcgtgaaaccgaatatgctcggtgccgatggctttcaggatcttctcgtgggtatgccggaaggaatccggatcgaacattcctcccgtcttgggcgacgggaacatgtagggatttcccgggtgcttcttgtgctcctccaccagcagctccaccgcctgctgcgagaccggcaggacacggatggaattgtgggtcttgggctggctcaccaccaattctcccttggtgcgagtcacctgcttcgtgatggagatggttcgcttctccacgtccaggtccgtccagaggagggccagcagttctccccgccgcagtcctgtggtcagctccaggtagaagggtgccagcagtccccgcttgtccgcttccatcagataggggcggatcttctcttccggcagtaccttcatctcccgcttctccatctttggcagcttgcggcctctcgcggggttcaccaggatcagccgctccgccacagcttgctccaagcagttgttcagcaaggtatggatgccatggaccacccggacgctcagtcccttgttcttcagctggatgtgctggtaccgctgcacccgcccgttcttctggagatcgttgtagaacttctggatctggatcgtggtgagcttgtccagcttgatgtcccccagttggggatgatgtggttattgatgtaattcagatagtagtccttggtgttctcccgaagccggggctcggcatagacctcgtaccacatcgtcacccagcttttcaccgtgtgggtgccgctacggttcatatccagtcgctgactgtccgcgatggcctttttcagtttctccttgatctccgcctgagtctttcccaggacattcttaattttctgcttcccgggcgccgggtcataggaggccgtgtagaatccctcccatctactatctttccgtttgcggatactgccctcgctgttggcgcgtttcttccccattcatcatctctcctttctcgccagctcacacgcccgttgttcgtcctcgttttcaaagttgtacggcgactgggtctgccagcagctcctgttggataccctgggccagacggtaaccggagatgaagctgttgagacacgcttcctcccgcagagcgtcttccagatccgccatcttcaggagcagtttccgctccggctcatccagcagacgggtgagctgcctgtaggtccgttcgactttcctgtccagatactccgccctccgggatgtcgtctcgaacctgcagcagagggccttcatatagtcacgcatcatgaatcgcctcctatcagcgacacacaatactatgacctgacctcaatagctactccaaccgggcagagttatcaaattgttagcaaattcaggaccgcttccgaaaattcggaagcggtcctgaactttacactcacatatgaagtctcggtgatagatgctgctgttgctccataatccgccgatgcacagggaccatgattctttccattcgggcagacagataagtctggtaaaactgccgctgcagttcatccagaaaaggaacttctctgatgaaagccagcatcttatccagatggaatcgcggcatcatgcgcatgaccgccgcattgcagtccttgtttccagttgccatcaagaaatcatagtagttgattttccggtcattctgtttgatggcagaagtcgggaagcggtaaatccgggcattcagctcatcctgatttgacaagaccgcccgcatcacctgggcatctgcctgcggcagcagacagctgccgcaatcatagattggggccagcgttgcggtctgggtgtcatcgtgatacaggaatccccagtttccgttgtgtcggtcaaaattccccagaagcgcatccaccacaaagacattccaaaagtgttgtagcacttccacaggattcacgtactgctgtttttcaatggtatccagaatgtcctccagctccgttccggtgccgccatattcagaatcgatgacggtattcttgatggagcagaagtcaaacagcttacttccgtctgcggtaaaatctttgcaggcgcagacgatcttcgtctttccccccacatcatacgttcccaggatggtttcctgcgcggggatcccaaccatgttgaagatggtgctggcgatgtgttcgctgatacagctattcgtgtaggacagctccgttctctttccctgaccggaaggaggaaatttcagcatatattgctcgccctgatgttcgattgcgatcttctttccgttggcaccgttataagcacgtccgggcacacgcttgcagtttgtaaaatcaggcacttcattcaccccacagaaacttctgacgcagataattggcatgttcatgtgtgatcgcgccatcgttgatctccgcgatgttgatgcttccgtacagctctccccacagacagtccagcagagaggacccctccgcaaggccttctttgtatgcgtccagatcatgctggaggtaaggtgggagcccatattcccatgagcgttcccgcatggcttccgccggctccccgcctgtccctattgagcagacctgcttttgtgccgacatatccttcataggaacacccctttctttgatttgtatgttgtattttaccacattgcctcgccgcaaatcaacgattgccctcatatcatatcttttcggtctgtttgtctacccattcctgaagtttgtccttgggtatcacaatgcgggtgccgatcctcagtgcgggaaaaccctcggaccgtgccaactcataagccccggcacgggagattcccagcgccgctcccatctcaggaaccgagagcatcagcggcagatcttcgtaagatttgaatgttccttttttcactggatatcatttctcctctccagccgtaggagaggtttttatttgttatacttcgtcttgttgatttatttccccaccatctggtgaagggagtgctctataatcaatggactccgtaaagattgcggacaatcaccatcctttcatggtcatgccgcccatgctgacacgatccatctccggatcttcgtggtcatcaggccggtggcccagggggtattgcgcgtccggaagattctgttttgccgcctgttccagccaatgcctgactttctcagcgtccgggatgagcagcccgccgtcccgatacagcagtcccaggaagtatttggcatggatatcgccgtactctgccagctactccagatctcccaccgcctcgtcccgctgatcgagcggcagcttgcggtcttcgatcttggcccgtagccgcaggcactcgtaggagacctcccaattttccacccactcgtctcgatcttccaccttttcatcttcgaatgtcatcacacccaggcggatattctccgcctcttggatgatagcgttcttgatctgccgaaactttttctcctgggccagcttttttcgttctctgggcttatcgtggcagtagttctccacctcattttggaggatgcaccactggtcataacactcacggaccaccagcagttcctccagcttgtccaccgcctcgtccacagttttcttcacggactcgggaaggtatccgtaggactttttgcccttgaccgtttccaactgtccgaccagctgctccatcttctgctcaatctcaggagccgcgcagagactttgcgccatctcctgcgtaagctgccggatcatgcggcgggctccccgcaccagctcgtcccgggactgcgacttttgttcgtaggtgtggagcatctcctgtttgaagatctgattggtgagcgcggatttgatattgcgggtaaccatcccacgtcaggtccgcttctcctggctgtgttgaccacgctatcatgtgcatatggggatgctttccctcgtcgcggaaggcggcataccagcggaagtggttcagctgaatgttcatggcggcggcgatgccattgcgattgacgcggagcaggttccgccatgctttggcattgtcgcagccaaggcgtgtggtgtcctcccggtgcggagagaggatgtacgtccagacgttgccggtgtagtgctccagttccgatatggcggtgtccaggtccacacgatccgcgtcaccgaacaggccatggtcacccagtcgttctgcacgaggacgtgttgcgatgtatttcatgtaaccatccgtctgctgcacctgcttccagtgttcctccagcgccagggtgatgagcgacgaggcattggcttttgtaggcttctgtacatagtcatcatactccagcagctctttcacatccgggaagtcttttgtcagctttgtgatgagctgctcctgcttgcgggttggcggacggtcatccgggatgatctccacccgctcccgtgtcgcgatgtagcgcatgtaaccgtctgcgccctggttacctccgcacttgatatacggacttttgacgatcagtcttgccattcatccccatcctcccaagtctcccgcacccgctgctccagcgagatgcagccattggtcttccgcacattttggacgctctccgtccgccgtcggcgcagctcctcgccgctgaactgatatgcgtcggcgaggataccagccaccagatcctgctccaccgcttgcttgtacagcagagaggacatccggccttcgagctggtccaacaggccgtccagataggacttgatggaggtagggagaaacaatccagcgttgttggcgctgaggtagtccagataaaagtccaccgcccgctcaatgaagtcggtgatgctccggctcctgtcctcctgataccggcgctccagaatggtcttttctccggtgacaggtagaggggaaacttctctttttttcccataatggtcttctttctgggtgtgacccctgttttttctttgtgggagtatgcgttgggggataacgaccgcagagatgatatcacggcccggatattgactccatttttgaagccacagaaactcccgtaattgcccgcgctacgggcagaaatgaccgaacagagcggcgcttgtgacgcctgttctttatccagcattttctttcgtcctccgcagagcctcgaaaccggcccaaattcgtccaaaatccccgggaggggctgggaccctgctgagtcccaagccactccacacagggcctcacagggggctcacagggagtcttctgcctgctgctctgccagcatcttctgcacccgctgccgctctgtctgggcctcaagcgtactccgctgccgggcgtagtagtcccgcaatacctcctggatagacggcagggtgtatttgagatttccgtttcggcgccgtccgcttttcagccgcacgtctgtgggctcggtgacgatcaggccgcgctcttccagggccagtacgtactttcgcaccgtgttttcactcatgcccaccgcgctgccgatggtccggtagctgggccagcactggtgtgtcctgcgatcctcgcagcggcgcaggtaactgtataccgccagctccccagcgctgagtcccagctggaacacttcgttgggcatcgtgaagtagttgttctgtgttctcatccgccacctcctgtgtgtgactccacccaccggatgaacgcgtcttttggcaccaccatacggttgcctacccgcagcaccgggaagccgtcctcatgcaggagttcgtatccggatgacggagacacgcccagcaccttcgccaccatctccgcgttgaggaacagcggcaggtcgtcatagcttttgtactccgacagcttcatgcttgtgcacctcctttactcgttttgtgttctgcctgaacgaaggagctgcaggaactcatccacagagtggaccatccccgcttccttcatgttctggtagcgcaccatgtcgcaaatcatgtggaagtttacctccgcgtcttccagcagcttgtccatggcaaggacctgctggcccactgtgagggttgtttttttgccggggtctttcagatacgcccgcacggcatcttcctccggcatcttctctcccagcacagctctcatctcatggatcacacagtccagcgtttctttctcacattgcatcttcagaagcattttcaaaaacctgcggttgaatttggttccatccataatcctgtacctcttccttcaattgtcattcatggctgcggccttcagccatatctccgatgtgtggaagcgtcgtttggggcacgatggttttctcagatccatcagagacatgagcgcaggagaaaaaatcccctcataaggggtagggataaaatcacggttttttacaacctatttttgcgagattttcaatttgtttacaatgtgtgtctcacgtcaactcgctgcgttctcacaacgcggaaaccattgcccctcacttactaggacactcaaagggcatttgtaaaccggaaaacaaaaaaagttgaagggctctgtcagatgacagagcccttcagcttttggtggagctttctcagccgctttgataccgccattttggacacgccgtagaactttccgatctcctccatggtcagacccctgtcatagcggaaatcgatgaactcgcggctctggtgatccagaacctccatggctttttgcagactttcaaggcggagggtccagagtacaggatcctccacgggacgcctgacgcattccgagccgggcagcaccgtttcaaactcacttttactcagatgcctttcgtcctgcttttcctgcgcctgttcccgtttccgatcctgctccaggaagtctgcgacctcctttggcactgatacttgctgcccactataaggaatcacgacaaagtcgttcatttgtgtcctttccgctttcgacggaaagtcacacacccgcgctgccggcacagcgccaaaaactgaagaccttcatggaagtttccttcgtacagggatggtgatggtgccctacgaggcccatgaacgtctgaggtcccaccggggtgtggacctcaccggaaagctacgagtttaggcttgcgcctggtttgattatatcatgctggaattttttgtcggtcgaaccgtgtcgaatgggagaggtttttgtgatcttcagaaagagaaaagcccggagctggtgatatgggccagttccggacttctgtactgtttactgcggcgcaagctttgaaatgtcaaagtacttatttcagccaaaactaatttcatcttcccacttcagcaaacgcactactatgtaatgcaaactgtaaatgctgaatcaggttcattatatccgtggggtccaggaaacaaacagtggcctttgaatggtacgcctctccgtgccgcgtggtggaggcagcagtcaatcctactgcaccataattgcaactttcattacatccgtatttggttcatgaagatagtcaaaagcttgctgaaggcctgacagaggaaagcgggccccaataaagccctccagatgcagctttccccgttgcatgaggtcaaatacttgtaggtagtgccgtcggacatattgcatgacgctgataatatcgatttctcctcgttgcaggtgtgtcatattcatcagaatatcccgcccatatgtgcctaccaaaacaatgcgagaagcattttgtgcgcaacacaccatgttttgcagcatttctgggattccgcagcagtcaatcaatacatctgctcctgcagaaccaaatgccccatcgatggcttgcgcaagagaaacccgattggtgttgcagcagttttttatgccgcagtcctgtgcgtattgaagccgtccgtctttaatgtctgtaattaaaacgttagcgcctctagccacagctatttgtgctgtgcagttgccgatggtacctgcgcccacgattacaatatttttcccctgttcagctccggcccgttccgctgcattagctcctacggcaaagggttctaccagcatacccatgtcatgggttactccctgcggcagcttcacgatgttaaattggttacatttataatattccgtgaaaaaaccgtcttcgttaatacccataaatttcttgtgggtgcagacgttgattctgccgtgccggcacggatagcaggtaccgcagatcaactgaggctgtactgtaacgagatcgccggggagaaatttcttttccgcctcgtagccaactgcgacaacttcacctacacactcgtgccccaggactcggggatattgcacggttttatgccctccacggaatgccaacatatcagagccgcagataccagtttgcaaaatcttaaataaaacgtcctgtggcccctgaatttgaggcattccccgcttctcaacggtaatctcatacggtgctgttagaacagctgctttcatgtcaaatatgctcctttcaaattgaatgtcagatgaaaggaaggaccggcccgccggaaagacgggccggcctgttgccttattcctgcgcggaggtattgcctgctaacgcaacagcttttttctacgggactttcggaagaaggcctgtcccgctaagacaataacagccgcaacaatgagacccagcgcaatggggtgctgtgtgaaagccaacaagtttccctggtcggcgatcatggctgtccgcaagtaggtttccagaagtggccccaacaggtatcccagcagaattgcaatcagatccagtttgaaatagttcaacagaaaataggcaacgattccagaaactaccattaccaacacttcaaaaatgcggttgttgatggcgtagacgcccaaaacacagcagaccaaaatagcaggaaaaagaagggacttgggaatccggatcatttgaacaaaaatgttcatcaggccggtttccatcagatacattacaatatttgccagaaaatacaccagcataatgcatccaatcacctccggggcgtccaccgccagcatgggtccaggctgcagaccgtggatcataagaccgccaatcagagcagctgtcacgttgtcgcctgggatccccaggcagcacaaggggatcagggctccgccgttgacagcgttattggagctctcagatgctgcgataccggcagcatatccggttccgaatttttccgggtgcttggacatggttttggtttggttataggccagcactgtggcagtatcctgacccacggccggtaaaataccggtgaaggtacctaacagagagccgatggtgatgcctttccacatttcatcccgctcatcctttggggggataaaggggacacgccgcacccgggttgttatccgcagtccggacaattcaccggattggctgagaacctcactgatggcaaacagccccatcagaaaagcggtcaggccaatgccggaactgagctgccactggccaaacatcaaccggtttacgccggtgacctggtcaattcccacagagccgatagccatgccgaaaaacaatccgattccgcctttggctccgctagaactgaccatggagagcactacgcagatactgaaaaaaatcagtgcaaaatactcccaatgcccgaactttaatgtgaccttggatagctgcggcgctatggtcgccaggacaatagcagaaaatgtgccaccaatcaaggaggcaaacacaccaagagacagtgcagcctccggcttgccacgcttgaccatgggatagccgtcccaggtggtgacaagagatgctgaggtcccgggaattttcagcaggcacgcagagattaggccgccgctgatgccgccaacataaatgccgataagagtggaaaggccttccgcagcagacatggcgtaggtaaaaggaatcatcaacgtaacgcctaaaacagccgtcaagccagggatgcatccaaagatgatacccatcaggatgcctccagtcatatagacaaacgacattgggttcgccatgaggtaagcccagccctctgcaaatagctgcattcacgacacctcctatatttcaagcagcgagagcgatttgacgttgctttgcgcgggtgagaagcgagtcacttgaggtactcctcataaatcggagcaaagatgttgtaccactcttcaattttcgcccccatctcatcggccgggataaagccaggcaggaagccaaagccttccagagcctccagataatcggggtcatcttgaaggtctgccatcttatcgttcagatactgaatctgctcgggagtggtatccttggtggcgaagaaggcacgatactgggcgccggtggcttcaattcccagttcctctgtgcagggaatatcgggataaatttcacagcgcttttcgtccacaatcagcaggggtttcacattgccggattccacggcggagcccagatcgcccacctgcatgaaactgacatcaacatggttgcccatgatggcagtaatggcgtcagcaccgctgtcgtagggaacctgggtggcaccttccaggccgagcccctggagcagttggatggtgaccatctgctgacgggcaccgatgaatccccaagtcagttcagcgggatccattgcttttagatcctccacactgttgatcccgctgttgggattggtaaccacgatgccgggatcgattaccatgcagggaagcggctccatcttctcccagagtttttcctcactgacaccggtcagatagtagcaaatcaggtccaggggactctgagacataatgtgatagccgtcgccgggctgtgtggaaaattcttgtgaaccggtataaccgccggcaccggtcataacggagcaggcgatggacacaggtagatcaatgttggccgccacagcacgggcgatgttgtcggtgccgccgccagcggcgtaggggaccagacacgagatgtcttccgccgggtaagcggcttcttcaccgccaccgcagcccgacagaatgccgatcatcataagaaatacgcaggccagtgccaagatatttttctttttcatataattttcctcctaagcaaaataacgaaatgtaggaaagaacggactcagaagaacttgacatgcaggatctgtgtaaatacgaggaccagaacggttacgacaacaagagaatagacaaaccggataagatagaacttttttttgctggtacgttcatgctcctcccgctgcgattcttcacaaagaccatacacaacgctcagacagaaagtgagcaggaaagaagcaatgggaaaaccgattagttcataggcgggaacgaaaaggagcagcgcaatcagagtaatgatcgtttcctttttcaacctgaatttgccagagtcccgctcacccttcagactgattgatttgagaaacagagggatgctgaataccatcagcagaataccgatgccttgaataaaggtgcggggttccgccagaaagggaagtccgacaaacagcatgacaccactaacagttgattctgatgcgaacaggaacaatccaattgcaaaagagagaatgcttaaaatgaaatcgttgcgcttacgaatggccatttacccacctccttaacttgccaaatgacctccgtccaccgggagcgtcacaccactaatgtagtcggaagcagatgaggccagaaatacgacagtacccatcagatcctcgggatgcccccatcttcccatagggatccgcttagtgagctgtttgccctgttccatctgctgcagatccttgctcatttcggtgtccatgtagccgggagcaatggcgttgacattgatgccgcgaccgctccactcagaggagagcgccatggtcaattgtttgacgccgcccttgctggagacatacgccggcatgttccgcaggccgatgaaagaattggtggaggcgatgttgataatttttcccttgccctgtttcagcatcaccttgccagccagctggctcataaagaaaacgcccttgatgttgacccccataatgcgatcccaagcgtcctcggggaactcctcggaggggcagcgatactgaagtccggcaccgttgaccagaatatccagccgtccacccagagctgaaatcgcttgctgaaacccgttgctgagatcgttgaggtccaatagatttgctaccacggcgtggtatccagatttggcgccacccaattctgccaccgtgttttcaacctgtgaatttgcgtccagaatgacaatctctgcaccggcgtcatgaagtgcgacagccataccataacacaggccggtcttttttgcgccacctgtaacaatggcttttttccctgccagggaaaaagcattcatgtcaaagcccatatgcgccctcctttacatttcaaatgtgatcgtatttacaagatcctctgcagacaggccacagagttttgccagctgtgtataggttccggagtgcagatgccgtgcttttcgctctctggtgcgggtgctgagggtggtaatcttttccggcgaccaagcgattcctcgccggtacatttcgtccagataagaggcaaacaggaaaccgttattctgttcggcaaataggattcgtttgccttgttgggtcagctgcgcagccagatctgcatcaaaggaaggcatgtccaccacggcgatctcgcgtccctgttcccgtaacgccttctgggcgttgagtccctcataaatgcctcggccactagtgatgatgacggtgtccgcatgaggatctccgtggacatagccctttccgtattcaaattgcagggattcagggtaaatggtttcagaagcggctcgtgtgagccgaagtagcaccagccccttgctacccttggcaatccatttcatgaccgccaccatcattcggggacaggctacatcgattacccgcaagtgaggcagctgcataagcgcggtaacatcgtcgatgctcatatgggtggcgccgttaacaccggtgtcaatgttgctagcggtagagaacaatgtaatatccagctgatggccctcggacagccagccgtcacttttggaaattgattccattcgctcttgctgactgaccgtaatccggcgcaaaactcgccagtcaaaaaagacgccaaaagtggagtgccagacgttatagccttttgcggcaaaggcctcggcgatgccactcatgttggattcagcaatgcctacattgatgccgcggtttccagcatgtttcagcataccgggctgaagaccagagatcaggcccatatccgcgtccaaagtaatcattttcgggtctctggaaaaggctgctaccatatccgcggcaattttgctgcactgcagcttatctccgattttgggatcgggtaggtcgcgctcctggtaatgcagagtcttgtctcggggagcagcccgtttggtgcggcgttgagaatagcggcgtataacacccacagggccattttcatcctgctgtacatcaatccccatcttggaagcccagtgcaggagttgctcatattcctccggcgcacgcacctttgcagcctgtagaaaatgacacaagtttttaatgcgggtttccctgcggagcgtctgctgatggatttcccattccgccagatcctgccccacggtggtcttgtggctctcggtggctttggagaaaccaccttcacccttgcggcattcagagatgatggccatggggcggctgtcgatccgatgttggaagtgctccaacgcatggtaaatcggctcgtactcctgaccgttgacatccaaaacatcaaaaccaaagctctccaatttttctcgcaagctacccatggaaagcatgagacggtgagagtcatcgttttgtccatagttgtgatcgatgagaatgcacagattgttcagatttttggcagaggcaaacatgaatgcctcccatggaatgccctcctgcagttccccgtctcccatcaggcagaatgtccgcccaacaccctctattttctgcgccatggcaaagccgacagcggcactgatgccctgccctaaaggtcccgtcgcgatatgtactcctggcaggatagggccaggatgtccattcagatcgctgtcacttccgcgggaattctccaaaagcgctctgtcaaagaaaccaaaatccgaaaagaccgatgccataccggctataccgtgtcccttgctctgtacgtagatgtcactttcacgagcagtggggtcttccacatttacatgaatgaaacctccgtaaaaaagcgcgatcagtggaatcagttctgagaaggtgccaccgatgtggattccctggtctacagcgtggtttccctgatataccgtatccaaacgaaggtccgaatccttgacttccagcagcgcatatagcgccttttgggcgatcgggtgtttcattttcagataatcacagctcaagtccatcttggccctcctccatttttttaaatggtattgtattcgagtgagcaaaatgcacaaaaatgatgctgtgcagattgctttataccgtaattttacagagagaaatagcattcatcaaggtatgtgttgcaaaataatgctatattttgtagcaatattaactcaaataagattttacttgccacaaaacctgctatatgctacaatttgaatcgaataaaaatggagggaggaggcccatgaaacgattccgtatattaatcattgccccatatttgtccttccaagagactgccgcgcccgtcatccaagagtttcctacggtggattttgagatgcataccggagatgagtttacggcaatctctatttttaactcctatccacctaacgcctttgacgcaatcattactcgtggtgcaattgcggcgattcttcggcagtttacctctgtgccggtggtggaagtggatgtatccttattggatatcctgcgggctattaaccaaccgggattcagcgatcagcgtgtggcggtggtcggatattccagcattattaattccgtcaaaaaagtatttgaagtgcttcaactgaaaaacacggagatttacgaggtgcgctacgcagaagttaaggaacgggtggcggaactggctgaccggggattttctttgattattggggatgtgccttccgtaaatgctgctatggcaaacggacttcggggactcctaattctgtcatcagaggattgtatccgccagtccgttattgcagccatctattattcggagttgatggaaaaggggcaggagatcactcagatttttcagacagttattgataatttaaaattccggattatcctgatggaccagataggcaacgtaattgttgacaatcgcgcgtttgagattaccgatcatcaaacctttaaaaaagagttgttgctatttattccggtgcttttgcagcagtccaccgataggggctgtaaaaaaatcggaacacagggaatcgaaattatcggcaaaagggtttcttatcgcaatcaggactgcttcctgttcttcatttcactgatgcataagggatatgcctcccaggcagacattaccatcgaaaaaccgctttcagtgacactgtccccggaatttatcaatactcttcaaaagaataacccacgggtacaagcggtggcggagattgtcaccgcatccgtgtctccgccgcctgtgttgattttgggagaatatggtaccggaaaaagcagtctggcctattatttgcatggcctgcgcaaggagccaatggctccgttcatctttgtgcgctgcaacctactgaccaggaaacgctggaatgcatttttggataaaactgcatcacctttgaatgaaaacggatgcacattatatctggagaacattcacttacttccaatagaactgcagcaggagttgagcgcctacatagttgattctgctgcggatcagcggcactttattatcgcttcggcaacgaataggatccaccatcttctgtccaatgaccagttcttgtatccgttgtaccagaagatttcgtctctccatgtaatcctggcacctctacgggaatttcctgattccattacggacttctcacagatttttttaactgcggcaaatcaagaatatcaaaagagtatccggggatttgaagaaggggtcgtggctctgctggaacagcagcattggaataccaatttatcccagttaaaaacgtttattcagcaattagtgttgaccgcacagggagcacagattactctgaaagaggcacagaccctgcttttaaatgacaatactattcccccggaggagacggaatacttgaattacagtggaattgatatcacaaaaccgctggaggaaattgagcgggatattattcagcatgtactgatggaggaaaacatgaaccagtccgctgcggcaaggcggctgggaattagcagaaatacgatttggcgtaagctccatgcttaaatacgggcgtgcagctgccggcttaaagtcgctggcgacaccattactaaaggaaaattgcggattggaatgacaaccagctctggataggctgcattgccaataattttaccggcagtaaagccgcgtcatttttgcaaagccggactacaggctttttgttggatggtactggaaacggaaaagtagcgctggaactgaccagcagctggtgtacggtgttgtatccgtcatagctggtcaatgggcgcactatggaaacggggtacaggctgcagaaaattttgacatttaccgctgctgactggtggttccggactactggtatatcttagatgcctcatcagaaaaggtgcgaaaagcaagctgaatctgaaagaactggcggctaatgagactttacctcacctaattctctctggaagctattccgccatggtacaaaggtaagtgtaggcttacctggaaagcagagtaagtgccgttcgtattgatcccgaacaactgctgtctggtgaacagacggaaaccgtactgcaagaagctataaaatctgcaaacaggaggcattccgctgtaaatcctgttgaattaagtgactgccagcgatctggcgcggaacgtatatccaagggttaataagccgtatggaagtttatggtagacattgcagtagttggcggcaaaaatcaggcgtggcaagatatcgctcctggcgtgctggaactgtagcccatcgaacagctggaactaggccttgtattgaaatctgggaatttcagatatgaacagcttttcctgacagtcttgcgtaccgcgtgggttagatataggctttataacaatcccgagcaaagataaaagcccactccagttggtttactcacctcctatacactttactgcggtacaaattttgagtattggagcccagggagatgcgaacaagaagttggacctaaatggggagtttcaaggtgcgcctgtatgtggcagatctcatcgcccccaaggatagcttgattctgccatcgttataccatattcatgcagggatctacactgctaatgaactagaaaacagatgtgctttcctagaaactcccgtaaaacagctcgttcttcaaccgtccttcctacgcagactgcattgtcggggaagtgacctcctttgagacatggagcaagtgagttcagcctgctccaagctttgaatttagccctaccagcggtaacgcccttcccagtctaaactggcgatcggatactcgccgcttctcagccagcggggataaggaactcctaatgtcaataacccatttgacgatgagcaagcccgcatgaaaatcccgccaaagggtattttccacggctgagcagatctcacccatatagaaatgatacctccgctttttcttccggactaaactgtaccattgcttttcctttcttcgtaagaatacatctcttccgcctttttccagtccatctttttgtccgcttgcccctggggattgggatgttcttttttcactaataagtaatcggaactttagccgacataacagagtcagaccacagcttgtaccacaggagtttgtggaacaagcggattttgcacagtaaatcacgcccgggaaacaattgaaatggagcagaaatgattaaaaaccgccggaaacaatcaaaaaagtttcataaagctgttcacacgcaggaggttactggttcgagtccagtagtctccgtcgaaaagttcctgatttatgtaaaatcagggacttttcttttattcgtctcaaaaaacatgcttaaacttttagcttcttctccgaccaatacggcgatagtatctgatagagctggacagtgtcgggcaggaaatccctgcccggtgctgccgtaatggttacagtctttttgtatggccagaaaaaatccggccttccatctcacacgcgtctgcaagctctttggcgagctttttgatcggaaagtctggtgcggtttgtataatgagtaccaaatgtccccaatccacatgcaggtttagaagagcgctcttctccggagtcgaaccttcatcaaaatgaagaggaaactcttttttcagaatagaacaattcagatagacatccgcccggggaatctctggttggatacactgatagagcgatgtatacaatcctttgggcagccggcagccggtcaaagagaaatatatgcctttcccctttgcccacctcctcttctttgaaccaacggcactgttccaacgccatttggcgcagttctggaaagcgcgcctcccacagggcacaggtatgtccggtatagtccgacacggtcagcgccacaggtagcccggcactgacctcttccacagtggctgtacaatcgtatggaaggggcgcagtgcttcctcctgttcggccgaggccgccagcgccccatatcctccgggtagtccgtatgatcccatcataccggcagttgcttcctctgcccggaacgctccgggcatcagccaaaactcccctaggtgcagttcgttaagcaacctgtcagttctttcttttcgttttcggaaaaccatagttactctcccacatctgtgatatcaattacccattttctcaaagaggaacctgcaacaccaaggagcaatccgccggcaatcccgcccacagcagtgccaagtcccggcaaaattgccgtaccgattgcagcacctgccagagcgccgcctttggcgccgagtgcacctcctgcccaactgccgccaatacttgcagctgtactataagtctttttgccaattttctgatgggcgtcatgcagatctccgtcaatgacatcacatagccccaaagcatccagtgctgcacccgcgaccaacagcactctccctgcgatcctgactactttggaaatctcggtatgatccagtccggatggaagccttttctgccacgccgaagcatttgtgagaggatccacattgataaggtaatagcttgtattccctctatgggagtgcaaatcggcaccgaaaagcggcatattacttccaaagaatacaaaatatggaaaatcccgtccattccgtgcgatttttgttgcagccagaatcctcgtccaactgctttggagcgggtcaagccatgccagagttggaaaggtgcctcgcgctaattcagccagaaagctctcacgagcaccgtcagtcttttttccgcaaactccgtcctccagcagccgctcgcctaaattcaattcgtcgagttcttgctgcattgccacccacaaaccatgccagccgctcgatcatgctgtcagaaatgcctgtgctgatcccgcagtgttccagttcgctaacagcggcatgcaggttgcgggctgtatcgtctgtgatatagttgttctctcgttcgttttgcgataaatcccgctgtaattggcgcacgatatcttccaaggagccctttatgcctccatcgtagtcatcgctgcatatggcaggaagatcctgcaaagggactttccgttccgcatagttcagatattctctgctgccaatggaatacccacaacgcccccgcagatctgccgatttattgttgctgcggtatgtgttcagtacatcccgtaagaattctttatcctttccctgtgaaatatcctgcggaaatgcagtctttcttgcatccctcccgccgcaaaggaaatactccaatccacagccttttgaagtaaatcaagacactcactggtaaagaagtccgaaccgctcttaattttttgaattgctgtttggatagcccgatcatcacgaaaagaactgcctgggagataaaaagaggatagattcaggatttctatgcagtcactgctatggctgcaaaaactgcgggacatcctgcatacatcatattagtgattgtacctgcttggcaagtgcgctccttcgatcagaggatatattgcgaatgacgtttatgtgttcctgcaagtcgtcgtagatctcttccactgcggcgccggcacggttccccatctcccgtaatgtttcgtggtaattcgtttctgacggtctttgcatcagcgtgccaaaaaaagcggcgcggtttacgcggttccaatattcaccgctccccagaacagcgccgttttcaccagttgcctccttgctcataggtttccttcctgagagttttctcaaatacaggcttacgtatgaagaaaactgcatgtttattctaacctctttgagatcaaagagccctgcaaccaactgccgccccagatcgaatagggtctatatccaggtcgactggtataagagacaaaagatctctccgttttttggttagtcagccaaatcagagaaacaaaaggtaaaattattgacaaaagataaaatgaaatttattatttaactatcagctgtcagacagatgacgtcctatcgattagttattagggagaactttttaaggagggcaatatgaaaaaacttcgatggacttgggacaattttgaggaagttctgctgtgcatcatcattacggtcatcacgctagtatcaggattgcaggtagtttgccgttatttgttcaacaactccctgacctggagcgaagaagtgagcagatatttatttgtgtggacgggctttctcacactgagtctttccatcaagtgccgctccatcatctccattgacgctttcgtattgtggatgccgcggcgcgttcgggcgggattgaatatggtggtgtacctgttctgctccgtggtgtttgctatgctgtcggtcaacgcctggcacatggtgacgtcctccgccggacagaccagccctgctctgggattacccctggcgatcgtctatgcgggtcccctgttgggtctgactctctccattttccggtctttgggccggatcgtggcggaaaccaaaatcgtaatcggaaaggaggcgccctaaatgtctctggcgttgtttttcggagtattggtccttctgctggtactgacggtacccatctgtgtatctttcgcgtttgtgacgttgcttccctccattgtggacgccagtttcccctatacggcggacgctgcggtccgctccatggtgagtggtttaaacaacttccccctgcttgcgattcccctgtttatcatcgctggcgtgatcatggcgaaggggcagatttctgagcggctgttcaatgtgttctcgtattttgtcggcaacagaacagcgggtctcccctgcgcggtgaccattacatgcctgttctacggtgccatctccggttccggccccgctactaccgcggccgtgggttctatgtgcatccccctgctgaccagtgtgggctatgacctgacctttgccaccgcactggtggccgtgtccggcagtctgggcatcatcattcccccagtatcccctacatcatgtactgcaacgcctccggcgcctccatttccgagctgttcctggccggtttcctgcctggtgtgctgatcgccctgtgcctgatggtctattcttacatctactgtaagatccatggagaggataaggacaagctcaacgccaaatgcatggaactgcgggcaaaaggcctgggcacagtgctcaaagagggcttctgggcgctgatgtcccccgtcatcattctgggcggcatctacggcggcatctgctcccccacagaggcggctaccatctccatcttctactctctgatcgtcagcttgtttatctatcgcaccatcaagatccgggatcttccgaaaatcatgctggaaggcattcattcctatgcccctatcctcatcattctatccgcggccgtggcctttgcccgtgtaatcacgctgatgaatgtagccaccatcgtcagcgaggcggtgctcagtgccatctcctccaaggtggttatcctgctgctgatcaacgtactgttgctgtttgtgggcatgatcatggataccggtccggcaatcctggtgtttacccccgtgctgctgccggtggcggaggccatcggggtcgatcccatccacttcggcatcatcatgtgcgtgaacttggccatcggctttgtgaccccgcccatgggcgccaacctgtttgtggccagcaacctctcaaaagtatctgtgttcgatatcgccagaaaggcagttccctttatcctggcgttcctgatcgccttgctgctgatcactttcgtgccccagatcagcatgttcttgctgcagtaagagctccgggcagctgcccgttcatagttctaattatttttaaggaggatattcccatgaaaaagttattggctctgcttttatccctggcaatggcattgtctctggccgcctgcggcggcggagagactgcacagcaggagcctggcggggatgccgccggggaaacttacagcttctctgtaggcaccaacactgcggaggattccgtcaaccatttgctggcagccaagtttaaggagttgatcgaagatcgctctgatggtgctgtcaccgtgacactgtatgaaaacggcgccctgggcggcgacgcggagctgacggagtcctgcattgccggttccgtggacttcatcgtgggcatgaccggctctctggtgaactatatccctgaggccgccctgttcgacctgcccaacgtgttccccgacctggaaaccgcccgggaagtgctggacggccccattctggcggagctgcaggccgcctatgaagccggcggactgaagctgttcggctatgccgattccggtttccgcgtcatgaccagcagcaaggcggtccgccagatgtctgatttctccggcatcaagatccgtaccatggagaatcccaaccacatcgcctactggcaggctctgggcgccaaccccactcccgctgacttcagcgagttgtatatgtccctggagcaaggtactctggacgctcaggagaacccctatgacctgatcgtggccaacaagctgtatgagccccaggcctatgtcattgagaccaatcatctgctgcacactctgaacatggtgggcagcaaggccacctatgacgccctgcccgctgatatccagcagttggtcagtgagtgcgctgctgaggcccatcagtatgcccgtcaaatggccgacgagcgcatcgaaggacagaagtccaccattcaggatgccggcctggagatcatcactctggagcccgccatgattcaggagatggctgatgtctccgccaacgtctacgatctggtccgcgaacaaatcggcaccgatctggtggacagcctgctggcacaggtggaaactgcttccgttgcggaataagcaatatagagagggcagggggtgtgaaaagcccccctgcctctttcaaaatcattttggccccgaatgtttggctactgtcccacctgaccgatgagccggagccggtgatgagactggcggtgcggatcgcactgtttccggattggtcttctctggacagcagaaagagaatatgaggcagagtgttcagagagctgtgaatcgatttccttggtcctgtgcagaagactctggattttgggcgaaacccagccttgacaatgcttgtatttgttaggataattttgtaaaggattgtatgcattttccatacataccaaactttgacaaaaggtacggtggactttatggctctcaaacagattacgcgagtgaatattgcagagaaggtttttgaacagctgcgggaccagatcctccaggggacctggaaggaaggcgaaaagctgccctctgaacaggagttgactgaaacgttaggcgtcagtcggagctctgtccgccaggccatccgtacactggctgattatgggatggtagagacccgaaatggcaccggaacctatgtcaagcggcagatttccggcaattacatgctcaatatcgtgcctatcggcgatttgcagtttgaagatattgtggaagtgctggattttctatgcctcattgaggacagtgtggcagccatggctgtccagcgctgcacccaggaggagctggcggaactgcaagcgatccataagcgcctgattgccgccaaggatcaaaacgatctggaggcgctgaccaatgtggacgtggaatttcactcgaaaatcgcgatgatcacgcagaattccctggtggttcagacttacgcgcttttactggagtttctccagccggtcatgcatcgcacctatgtgaccctgggcgcggaggaaggtattccataccatgagcgactgatacaggccttttgtgcgcatgacgcggtatctgccaaaaatgtgatgggggcccacgcacaaaaccggagggataaatttttggcactccaagaaaggattgaaccatgaagattacaagcgtcgacattttcctcctgcgccatgtcggtgaggagttttcccccttcccttttcgtccggcggtgtgccgtgtcaatacggacgagggatctgcgggtatggtgaagccggcatttccgtaggaaccggtgaaaacggcgtggcctatatgctcaaggacctctctcagctggtcttggggaaggaccccatgaacaacgaggtcatctgggaggacatccataatgtgctccggggacacctcagcggaggcggtgtgacggtctactccgccatgagtgccttggacaccgccatgatggatatcaagggcaaaaagctgggggtccccatctatgttctgctgggcggcaagcatcgtgacaaactcaagtgttatctctcccagtgccatttgggttatctggatgattaccgcctacaggccactatacagcagctggccgatacctgcgccaagatccagaaggacgggtatcctgccgtcaaattcaatgccgtggcttttgacgagcaggcaaagcccctgccccgggagatgaccaccggtcccttggagaaaacgattttggatcttgcagaatcccgcctggcagcagtgcgggagcggtgcggtgaccagctgggcatcatcctggaaaatctctgcgggaccgatgtgaccgcggccgtgcagctggagcggatcgcccgcaagtacggcgtgctgatgatcgaagaggccacctctaacttcaatcccgccctttacggagagatcgcccggagagtcgagacaccgttggccactggtgagcgtttccacacccgctggggctttgaacagctgctcaaacagggagctatttctgtgattcagccggatatcaccaactgcggaggcctatccgaggccaagaagatctgcgacctggcacacatttatgatgtccgcgtccagtgccatgtagccggaactcctatcgcggaggccgctgccattcagctggaagccgccatccccaatttttacatccacgaaacctaccatatggcagcgcatcctgactgtgtgtcctacggaaagtacgcttacgtaccggaaaacggttatttgactgtgccggatctgcctggcctagggcaggagctttctgacaaggccatggcggaatcgctgggacatatcgaggtccgataaggtaaccaattttttgagatacagaccgtgccgagcatggcagcttcaaatccgctgcgatgggaacttgccccaagcatcggcccctaacaggaaaaacgcagatagaggcagtggagtagatcggatgataattaccctcgttaacagctaaaaacaacaaatagagcgaaaaggacaggacaacccgttctttccgcacctagtttatcttcgcatctatatggacttccatcgtaggcccggttgtcctttccaatttctcgtccgattttcgggttccccctcagaatcaaacatctaaaaaattcatcccatgcaacttcttcagcaaaaagcgaccaatatagccatacagttcaactgaaaagcgtacgattcacacgcagaagctcgctggttcgagtccagtagtctttgccaaaaagaacctgatttcacgagaaatcaggttcttttctttgctttttgcgtatttgcagtgccccgatttttttggtgtttttgattgactacagaaataccacagacaggaaaactcccgcatccgcgggagtttctttttcgctttcatggcggcaatcagaactctcagcttctcctcgcactcttccggggtatggccgcagacattccgggagctctgcttgccgtccggccctccgggtgaataccgcccttcccagaggtggtcgccgatctgattgccgctgccgggctttcgccgctttgccatggtatcagcccctttccgaagatctcggtcatgaaggtgtccatcacctgggccgcctgccgctgtatatcgtcggtgacgttggcgtaggtgtccaaggggaagctggccttggtgtggtccaggatgccggagcgggtcttggcatccacgccgatggccagagcaatcggctccgctttccaattaacaataaaaaatcggagtaccccgaaggatactccaatcgtccgcgtgtcatgaaacggcctgtgaaatccggtaataccggtggtttataagcagcagacaagacacttttatcttagatagtccggtcaagcacagtaacctgcgtgatcacatcgcgcaggcggtcagatcctaccatatagttcaggacatcgtcagctgttgcgaagtattgtgtagtatcaggctgcccccacaggtaggcaatgattcgtcccctggaatggctgatcccgtattctttcccatcccaaataaagtcgatttcaccgcctttgtccacacaccatttaaaatcactgattgaaacaaattgattctgttcgggtgtattagcgggaatcaaaggagtcatggaaacaatctcctttctttgtatgaatcgcttcaatggcatatccataggattaaagcttggacctgttggtgtccatataatttcatgggcgtggggatttacatgctcccccgggttaccatggtctgaatgatgaatctcataatcggctttaccatctgggccaatatgggtctcataaagctctccgtgtttattatatgtctgattgatatcgcccggattccctaagaacttccaatcgtttggttttttagggtttggtttccagtctgcgccataagcactgccgccgcctttgccaatcaggtacggctctattgtatcacgatcaccactcgatgtgctgccgattttaaaggcgtccaaatcttcaccacggaaactacgctcgtaatccacgtagatgatattgccctgcatttcaggaaacggtgtattgtaacagatgattttttccggctcaatgcgccgcagcatctcgtcatatcctgctatgaaccattctttctggtcacagcagttgtcatgctctgtggccatataagttgagacagcaacaacgcttcctttttcaatcccctcaaagcagaaatcaaacgtagattcgtctccccagttgacggcaggaatcacccggattcctttggatgcccaatatgcaccgcaccagcgattacgaaatacattgtaaatctgcatgacaggcgccatctccaggtacatactgaaatccggcgatagcaccgcacggtagcgggacagtttttcgacgtcattatctgggtgcttccaaacccgctcaaaacgatagtcatataggaagaagtgaaccatccggtcaagatgattctgatcctccaaatgggtcttgtcgaagcctatcaacaaaaggtcgtcaaagtctccgggcttttcttggaacatgggaatgatggggattttcaactttccgttgccgggaaactgattgcgaagcagcgcctgactggttcggtaattgtaattttcttcggtcataaataggcctcctgtgtgaagtaaggaataagtcctcctacatacaggctcccgattggaaaaagttatacagtttcgcgccgcaacatgagcaattttaaatcagcaataaaaagacggagtatcacgaaagaatctgtaattattcaaagcagaaacaattttcagaattcgcatctgagttttatgcagtgcagaaccttaccaccccttcatggtcatgccgccccgggaccgggtttgttcttcttcgtggttgtctggctgatggcccagagcgatccgcagcttctggagctcttgcatctgcttgcagtcgatgtgcagcctcggctgtgcagtcacggcagccgcattgtgctggaagatatagctcacgtgaaagtgcatagccgctgcgatgtcattgtggtgagcacggagcaaagcccgccatgcctgtgcgttgttatagccgagacgctccgcgcgaggctgcattgcgatgtacttcagatagccgtccgtttgctgcacctgtttccagtattcctccagtatcagggtgatgagtgacgacgcatgagcttttgttggcttctgcacatagtcctcatactccagcagctctttcacatccatgaagtctttcgtcggctttgtgataagctggtcctgcttgcgggtaggccgacggtcattcggaatgatctccgtcacaatatacctcttgtagctgatctgctttttgagcacctgcagctgaccgtcgatggctgactggatcgctggtgagagcagcacgctactatcgtctgatgtcaagtaggccgtgtagaagttcgccgccttttccacggacttgctcatgctgcagcagctggcatcgctctgccagcgctcgattttctcccgggtcttcggctgcagacgaagctggagccgttccttctctgttacggaatttcccctcctttccaataagatgtcatgaaaaacgtctgttttctaagggatttgtgcctctctgatgacagatttatgacaaattatatttgattttcattgcctttcggcagtgtgaggcggggaacaatctgattttcccgcgcaaaacatgcggcaaaccagtcccgtttcatgtgttcagcctagcccggggataatcatgaacccatttaggagcattttaaaagctgtctggatatccgggtccccggctccaaacagtcgggcagcttttggacggaaggccgaaacggtatcccgcaaaagatctatccctggtgcttttacaatcctctcactgtacacatggttttttgtgctgaggagcacctttctttgatcgatgcggcatagtttcagcctgacatgtgccgttccgctttcaggcggacacagaacagaaacgtcacaggcagaagtcacgaggcaggcggaataccgagccagtaccttcccgacacaacagcacacaacagagcgggaacgggtatgagcgcaggcccctttttcacgcacggggccgccggcctgcgtccgtcagtctccagcaatcctgcgctttctggatttcatagcgtgcaggagaaaagtgaagccagatggatgtatgagagactattggccttttatataaggttacccgaaaataaaaacaaaaaatttttattggagctttgccgtaccggtatcaaggatgcaatgcctcatataccagattccgttgtcagcgtgtcagccttttaaaaaagcacgcacattgtctacacccccatgccgcaggactttgagatatgtaccttttctcagcgcctgatataaaatagccacactaaaatagccacacccttaggtgtggctatttttatatgtcacagggacttccagacgttcagtgaaaatgtctgaccgtgcataagtgccgcctgctctgcagatgcagaaggtttttgtaaacatataacaaaaaagcacttacacatttacacaaaatgacgtttttgaaaaaaagccaaaaatcctcccctgtcatgtgaaaaacaggcgttccaaaaatgccgggtgttcgataaaataatcacaaagaggtatatgtgaggggggagaactgcatggagtatatcttggaaatgaaggatatcagcaaaaccttcccaggcgtcaaggcgctggaccatgtccagctgcaggtacggccgggagaggtccatgcgttgatgggagaaaacggagccggtaaatcgaccctgatgaaaatcctgatggggatttacaccagggatgccggtggtgagatcctgtttgatggcaagccctatatggtttccaaccccaaggaagccatggacatgggcgtggccatgatccaccaggagctcaatcccatcttggatatgaccgtatacgaaaacatcttcgtaggacgggaactgcgcaagaacggtctggtggacaaaaaggccgagattgaacaggctcagaagctgattgaggagtgcggactgcacgtctcgcccaaggagacgctgcggaacctgacagttgcccagtgccagctcatcgagatcatcaaggcgatctccgtcaacgccaaggttatcatcatggatgagcccactgccgccatcaccgaccgggaagtggagctgctgtttggacatatccgccgcctgaaggagaagggcgttgccatcatctacatctcccatcgtatggcggagatcttttccatctgcgaccgggtcagcgtctaccgggatggacagtacatcgggacaggcaccacaacggagctggacgaaggccagctcattaaaatgatggtgggacgggagatcacggatgtgtatccaaagctggaggcggacatcggcgaggtcgtctttgaggcaaaaaacatcgtccgggccgacaacaaggtcaagggcgtgagcctgtccgtccgccgcggtgaaattctgggaatcggcgggctggtgggcgctgggcgcagcgagctggtggaaggcatctttggcatgcacgccctttcacagggagagatttttgtccacggcaagcgggtgaagatctcctctccggaggacatcatcaaacagggtgttgcgcttatcaccgaggaccgaaaggtcacgggactgaatctcagcggcacggtcaacgacaacattgccatggtggccatcaaaaagctcctgacccacggactctacaacaagggaaaagcccgccgcgcgtctgaggagtatatcgaaaagctcaacatcaagactccttccgcagaccagatcgttggaaacctctccggcggcaatcagcagaaaatcgtcattgcaaagtggcttttgaacgatccggacatcatcattctggacgagcccacccgcggcatcgacgtgggtgccaagcgggatatctacctgctgctgggcaatctggtgcgccagggcaaggcggtcatcatgatctcttcggagatcccggaactgatgggtatttgtgatcggattatggtcatgtgcgagggcaactattccggagaggtcagccgggaggaattctcccaggagcggatcatgacgctggcctctgccatcaaggtgtaaagggaggaagaactatgaaagaaaagagtcgtgcaaaatcgctgatcagcgaatacttcatcttcgtgatttttattgcgctggtggtggtgctgacctgcctgaagcccagcttcatccagcctgccaacctggtcaatattctgaagcaggcctctatcaacggcattctggcattcggcatgatgttcgtcatcatcgcgggcggctttgatatgtcagtgggctcaacggtcgcgttcaccggcatcctggccgccatgctgggccagggacagtatccgatcttcgtgccgctgatcgtagccatgctgggcggcctggccgtgggcgttgtcaacggcgtgggcgttgccgtgggcaacctgcctccgttcatcatgacactgggaaccatgacggcggtccgtggtcttgccctcctgatctccgacggcaaacccatcatcggaatcagcgaatcgtacaaggctgtggcggcgtcttcgatcttcggcattcccatgctggcggtctttctggtgattaccattctgctctgctccttcgtgctgtcgaagacagtctacggccgccgggtatatgcctgcggcggaaatctgctggcagcgcaggtctccggcatcaacaccaccaagatccgcatctccacctttgccatcgcggggcttctggcaggcctgagcggctttttaatgacctcccgtgttaccattgcccagcccacagcggctgagagctatgagatggatgccatcacggcctgcgtggtgggcggcgtctctatgaccggcggcgtgggcaagccttggggcgtggtgattggctgtctgttgatcacggtcattgccaacggtctggacatcatgggcgtgtcttcccactggcagaagatcgtcaagggcgccatcatcgtactggctgtgctgatcgacgtgaagggcaagagcaagaaacgctgaacggtattgagagaggggcgttccccgtcctgctcttgatatatatcgaaatgaaccaaacatttcaaggaggaaagaacatgaaaaagaagaagtttctggctctgctgctgaccggcgccatggcgctggccgccctcaccggctgcagcagcggcaccgagaccaccgaggagagcactggtggggatgcgtccgccgagagcggagacggcgcctataagattgccctcatccagcagcaccagaccaacgcgttccagatcggcgtcaccgagggcgcacaggcgaaggccgatgagctgggtgtggagttgaacattctgagcgccgatcaggacgctgccaagcagatcagccagatcgagcagtgcgtgtccgagggctatgacgccatcctgttcgagcccgtggatcccgatggcctgcgcgacgccgctaaggccgctgccgacgccggcgtcatcatgataaacatcgtatccgcctgcaccgactgggagtccgccggcatctctgccgtgtcctgcggcgacaacgtcaaggccggcgagaatgagatgcagcatgtagcggatctgctgggcggcaagggcaacatcgccatcctgaccggcccctcctccaccaccgacacgaccgcacgcctggagggctatcgcaatattctggccaactatccggacatgacggaagtgattgctcccgcggactgcgcatgggacaccgccaaggcccagtccaccgtggagagctggctgtctgcctatgatctggacgccatcgtctgccagaacgacggcatggccgtgggcgcgggcaacgccgccggtgccaacagcggcatcgtcatcaccggcctggacggcacccccgacggctatgaggccatcaaggacggccgcatcaccggcaccgtggcgcaggacggcggtctgatggcttccagcggcgtggaagctgctgtcaccctgctggacggcggcacgctggagaacaatctcatcatcgcggacagcgtgtggattgactcctccaacgtggcggattacgagtaagctgccaaaagcgacaaattgatccgctgattctccaaaaattcttggcaaataccgagaaatagcgtataatgacagggaaagggaaaacgggttcgttttccctttccttatcagaatctgcgtgggaggtgctgcggatgctgcgggtcgttttggccgatgacgaaaacaaggtgatcctgctgatgcagaagctgatcgactgggaggcgcttggctacgagatcgcaggcaccgccaacgatggactgcgggcattggagctggtgcgggaaaagcagccgcatctgctgatcacggacgtccggatgcccggctgcgacggcatcgaactgatccagagggccaaggccctccagcccaagctgcatttcatcgtcatcagcggataccggaaatttgaatatgcccagaacgcgctgaaatacggcgtggaggactatctgctcaagcccctcaagcaggaggagctcaccggcattttgctgcgcctcaaggagaagatggggcaggaagccgcgctggaattccagctgaaaaggagcggagaacaccagcaggagctgctgctggacgccctgctgggaacggcggagcgtggcacctcctttttgagcgccgggcaggccaacggggagtatggatttcactttgggagcggcacttacgccgccgcagtgatccgggtggatgtgcccgatgcggaatcctatcaggacggctaccggatcctgctgcgccatgcgctggaaatcgtgcggcgggagagcggcctgctgacggaggagttcgcggcctcgctgggccatgccgggatcgcagtgttgctgtacctgcgggcctatcatgcggtggaagtgacgcagtgcttcaccaaaatccgcaaggagatcgaaaatcagcgggacttgttctggaatgtccaggccaccgtctgcctgggcagccggagggactctctggagcaggtgggggaatccatgcgggaggcgctctggctgtgcagggatcggctgtgccggccgcagtcctggcgggatgccgcgctggagatgccggatctggcccggcggtatcagatggacgcgtcccggaaaaagagctttcaggtggcggccgagtgcctggatgaggtgcgctttgtgcaggagctggaggagagctgccggacggtggaggcgctgccggacctgaacgggcagatggtggaggactggttccgccaggttctggaggcatgcctctacggaatgcgccaaagcggtgaaacggaagcgcccctggaggaggagatggataagcggttctggcactgcacggacatggcggcagtataccggctgctgcggcagggcatccaggcagagatccagcggctgaaggaggcgaaagccctgcgggagatgcggccgatcacagaggcaaagcactatatccagcagcactatcaggaggccctgcggctggaggatgtcagcaccgccgtgggcttcaacgccacctatttttccacactgttcaaaaaagagaccgggcagaacttcatggactatctgacggagctgcgcatcagcaaagctaaggagctgctgtgcggtgaggagctgtctgtgcaggatgtggcagagcaggtggggtaccgggatctcaaatacttttccagattgttcaaaaagcttaccggtgtgagcccgtcagattataagaaactttataagtaggtgataccatgtggccgtggacggactggaaactgcggcgggcgctgcggcgctaccggcgggagcgggacctggaggccgttttgcagatggactggcaccgggatttggatctgagcgcatttttcacagatgtggaagagcggcttcacggagaggagatcaccagactgcggcagaaacaggcggaatatctggcgctgcaaaaccagatcaacccccacttcctctataacgccctggaggccatccgcacagacgccctgctggcgaactgtccggatattgccgagaccacggaggctctggcgacctttttccgatacaccatctccaatgtccaggagtatgtgaccttttcagatgagctggacaatgcggaaaactactttaccatccagcgctgccgattcggtgacaaaatctctctggaactggagctggagaacgagcggcttttggaagtgcggatgccgaagctcatcctgcagcctctggtggagaacgcagtatcacatgggctggagggcaaactgggccacggcacggtccgcatcattgtggaaaacagcgaccggacatttttcctgcgggtgcgggacgacggcgtagggatgccggacgaacaggtggagcggctcaacgcgcagttcggcggagttgggggcgcggatatgacccagccgtgcggaggaatcgccctgcggaatgtcaacagccgcatccggctcatgttcggagaggactacggcctgcatttgttcagcgccgcgggcgttggcacggagtgctgcgtgacgttgccgctgcgtttccgggaggcgtagaaccgtgagagaggaattgatccgggtggagaacggctgcttccgcagggaggacgaattctaccgttttgaaatctccatttcccggggggagtgcatcggggtctatgtggacgaccattttacctccggcaccgcatatctggacctgttcaagggcggcacacacctggagcggggacgggccttttcctgcggccgtcgggtgggcccgctggaactggaacgctggatcctgcaaaacgccaggatcgtgaactggcaccggttccattcgcaggagctgacggtgcgggacttcctgctggcgctggaccgtccggccggctggccgcagagatggggcgcggtccggcgcctgcacagtccggagagccaggagatccggcagcggatggaactgcgtgtgccgctggagagccggcttgccgacctctccctgctggattattaccgcctctgtgtatttcgggtgtggttctggcggggagagttgctggtcctggaccggatcacagaaatcctgcggcggcgggatgtggaaaaactgatggagtgcgtacagctgctgctgcgccaagggacggcggtattcctgctggatctggacgagacattcatgtaccgctactgtgaccggatcgacgtcatccgggaccgcaggacctgctatcggctttacccggaggagtacggggagcagctctatgcagttctgggctggaagccccgggaccgcggagcggagcatacagagtgccgctgggaagacaagcaggtgctgcggctggagggtctcacttttccgggaatggcgccgctgacctgccagattcacagcggagagatcgcctacttccgggacgagaactacacggctgctgccagactccgggagtgctttctgggcggcaggaactggctgagtgggatgctgtggctgaacgggcaggcacagacacatgaagagatgacaaagcagatcggcacggagatcgggattcagaccgaacggccggaccgtcccggcggtgtattgtttgacaacctcaccgcgctggacaacctgacgacctgcctgcttcccaaggccggataccgtctggttcgccggcgggtcgcggagaatattttggaggaggcctccagatggtttccccgagaggatctgctgcggcctctgcgcacttggtccttaccggcgcgcctccggttctcctatttcaaatggtatctgctgaatccgcagctgctggtctgcttttttcccttttccgggcaggagacggcgcatcatgaactgattatcgacctgctggttgcctgcgcagaacgcgggatggcggtttgggtcatctcctccaacattgacgcgatctgcgaaaagacggaaaaccaggaatttctccagcgcctgcgaaccatcaactgacttccatggaaaaccggcggcagacttgtggcacaaagacctcctttttcctccatccagcattttttgctgcaggacgaaaggcatccgcagaattttgcatggcgcggcagttgcccgccggtgtcggcacatgcccgttggcggtgccccggcccgccatgcagcgctattcatgggttttatccccatttcagatacccgccgaaaagcgtttagctgccttgcggcaagccggacgcttttctttttccccaagcgggtgagaaatcgttcccagaaccaccttcccaaagaccagcagggcggattgcagctgccgtaatactgctcccagcacactgcgtacacctgccacccggaagctgcaggcgccgctctcatagatgggcgcccgcaccatctcccagggcggagtgacagaggaaaaggtctggttctccctggtggtggtcagtgtgtccggtcccatgggagcagatccacatttttatccctccgccagtgagatccggatacaataccgccacatgggatgtgggggcctgaagcccgcgtactttggcgcagtgccctcgttcttctggcgccggttgttggaccagttcaccgccacagcgccgccctgacggagcgtgatggtccgaccgctctgtgggatcaccaggaagggagcctgtcccacagcaaagttaaaccggagggcggtgctctctgcgtcgggaaggcgcgccacggtaaggccattcgcgttttccacattctggccaccgttgagagccaccagggcaatgccggcacggccgggaggagcagccctggcatacatcccacgtccgcgttctgtgccggttcagtgtgatggtgattgatggatatggagagctttgcttttcgctccggtctgctccacctccacatcggcccgcgctccctgtagtcgatgccggaaggcccctcgtccgtcagggcgttcaccatcagcggctggatgccgccggtgaaggagatgtcaccattgtcccaggggtcggccggattataaaagctgtcccgctgtttctctgcgatgtcccgctctgtaaagtaggcagcctggacatgggccaagtatttttcgatgtccaggaccagtttcagctcctccggagtgtagttcccccatccacggtgatcttcttatctgtaatgagattgccccggctgtccaccagtccatggaactccagcatgcggttgcgcatcaatcagcctccaccgcggcgtaggccgggggcagcagcgccagcgggaggagatggggaacggctggcctggctggcccctcaagtttacacgggccattccgccatcaattccattccgcagagcacggccgctgccgcgcagcgtcaatgtccggggtacttgccgctggcgcagatccgcctccggggcctcggccagctcctcccgctgcactggtttaaagagatattgaatggggtggcctgatagcccgccttcaaatatgcgttgctgcggtggtgataaaaaagactcccgccctctcgtcccaggaccgcagctcccaggcaaactccatgccgctcttgccagccatacagatgtccagacagaacaggttgaaccacgcccccttccgcatcgtggcttccagattctccgtgctggaaaagggcctcccctcgtgctccacgttccgtccccgcaggatatcctcctgtatggcgcagattcctccctgcatgggtgccgaaagagtccgcagcatacagcaggtcgatgcagaggagaaattgtgcccgtcaaatgggtcaaaaacagcgtcaaatttaccgccacgccagactaccccaacgccatttacatctgcaacaccagcgggcagacctacagtctggtgacgattctggaagtggacgaataaaagggaagccccccggaaatccggggggctccgctttgcttgagaaacttttgaagctatactgcttagtcagcctggctgagatttacagtatactccacagaagcgccactgccagcgttctcaaccgtgacagtaatcacgatgggagtaggcgtcagatcgctcacattacccagcttcggagtcagctgagcagctgccgcagctgcattagtacccttatcaatccgctcggcagatccatccgggaaagtaatcaggatggagttatcctccagcagatcttctgccagaacaaacaagccagtgccgcttacatcggtccaatcagatacggtattgttgagaacaatgttcagagtgtcgccgctccgagtgatggtcgcaccagtgggagtaccaggattataggcatccacaatgtccgcgatatcttcctcagtcatgtagttggaaacactcctcaccatgatggcctcggtcgcctcgatctcataggtgtcgttggcagccgcgcggaccagctcaccgttcacggtgtagtcgccagcggtggtgaaggtcagctccacaacctcaccgtcggcaatgtagtcgccgtcggaaacggtcttgccgttgacctcggcggacacatcggaggtgatcgtgccgtcaatatccagctcgtaggcggtgacaaactcacggtccttgttggtgttgctcacagtcaccttgccggtgctgggaacggtcagcagacctctgttgctgcctccaatgaagccatcgggattctcattgatgtcgaagtagttgccagcgggaatgttggtcagattggcggcatcacccttgtcgggatagctgacaacctcgccgtcaatgctgatggccacgacctcgatctgagtgaagttcacgcggtacatgtcgccgttctccagggtgacatagcccatgaacttgttcaggcgatccacgggagcgcccagcaggtcctcgatggcggccttgatctcgctgtcgctcatggacttctcatagtagcgcagctcgatccccttcgtagtcggattccaggaagcgggcaggaactcaccctcgggaaccgtgggattgctcacatcagagccagccttggctttgtcgttgatcacgatgctggtggccacgccgttatccaggatcgcgctcacctcgaccacgccggtgccgaaggtgccctgggcattcatgtcgcgcagagccttctccaggccgttgtagccggtgtaggagtcatccacatcatcaaactcgttgcccttcttgtcggccagggacagaaccaccttcacctcgggagacacggagaagcccttggtggcgttccggtcggtgtacagggtgccgttcttgaaggtcagcttctcaacagtgttggtgtcggacagcaggacggtgtcgaagtcctccacggcgtcctccacgtcctcgacctcgtcgacgaacttgtcagcagccttggagaagtcgatggcctcgaccttacggacattgccgtcagcgtcatacttgacctcgaaccactcgccctgagccatctcaccctggttcttggaggcgttgccgatccactccagggagtcgccgacctcggagatctccacgagctcgccgttgacgaccacctcgcgggtccaggtccactcggtctcatcgtcgtaagcctcgcggttcacgttgctgctggtgacatagacgtagttggaggaggtgccctcgttctcgccgatggtgacagcggcgatcacatagccgtcatcattgtaaagggtgtagatctcggcggcaggagcgatgtagttgccatccttcttgaggtcctccatcaccaggttgacgttcttcacgccggtggtgacggactccacgtcgtccacgatctggcgctgatcgccgccagtggtatcctcgacctcaacgttcttcagttccacgttcaggtagacggagtcgtcgttgccgtagacgtagctgctgttgttggcggccttcagggacacgtgcttcttatcgatggtagcgccattgctgcccacatcctgggcatactgggccacatcggtgtcatcgtcgatgacgttcttggaggtggacacggccacttccttcagggtgtacacgttgtcgttgttgaccgtgtaggtgcaccaggtgttcagctgagacaggttcttgccagtggtgtcgatgtcgctcttggtcatgttcacggtgacggtatccatgttgccgtccatgaagatgacgttggcgtcagcgttccgcacagacaggttgctgttcttgccgtcgatgccggtcaggaacacgtactggtcgggatcctcgttctgctcaatgccgatcatgtagccgtaggcgtccaggatcacattgtaggtgacgtccttcatattggcgtcgtcatactgatccagcacttcctcatcatacatgacggtgtcagcgtagtcatactgggtaccaccggcggtaacatacttctccaggcggaagttggagatgctggtgtcggacaggacctcgggagcgtccatggtctggatcacgccctgggcgatggtcaccaggaacaggtcgttctcagccacttcctcgatggcgaagtcctcgccgtccacagagatggtctgcttctggggcttatcctcgtcagcggtcttcatgtagacgggcttgcggctggtgccgttgttgtccacatagtagacatccaggtccacgtcgtcgttcttctcgtcgtagtcctcggcggccttggccagataggtgttgatgatggccacggtgatctcgtcgtcctgggtgtccaggaacacctgggtcagcacgccgttgccggtccggccgatggtctcgtcgttcttcttcaccatgtcggccttgccgaaggcggcatcacccagattctcatcctcgccgtccacatagacgaacagggtgttgtcatcaatggcggtcttgcccagcaggttgtacaggtcctcgccggtgaccttggtggtgtactcggccaccatcttgtcgaagtccacataggtgccgatctcggccttcttccaggtccaggtgtgggccggacggccgaagtcgtcggcggtgtccttcagagccaggtcgggctgatacttctcagcgaactcaaccgtccagccgttcttcacgttgtcggtggcgtcgttgatagaagtggcagcgtcgtggatgttgctggtcacgtaggtgggcttggaagcgccgatagcaacagtggcgccgttgacggtgacgtcggtgcccttgttttcatactccaccagggtggctttcagagcgttgacggcatacaggcaggcctcctcacgggtggcggcacgggtgccaacaaagttctcattgcccttagtcagaccggcctcgatggcgcgggaggccacattgacggtccagttggtgccggtgaagccctcgatggcgctgtcataacccagagcggtcagcagcattttcaggaaggcaaagccggtcagctgcgcagagggccggaaggtgccatcggcgtagccgtcgatcaggccggactccacgcagtaggcgatgtagccggcaaaggtggaacccacgggcacgtccttaaagggcgcggcctgggtgcccagggcctcagccgtggtcttgccaagcatcatgcaggcgatgatcttggcggcagcgccacgggtcagggttccctggggctggaaagcaccgccggcatagccgtcgatgattcccatttcggacatcacgttgacagcttccgcataggcttcgccgctgaggtcttcgctgtctgtgaagtccttggcaccggcgctgacagtgaccagagacatggtcatcaccagagcaagcaccagagaaaggaacttcttcattgggatttctcctccttttgaaatttgcggtggtccgccgcggcctccgggcccattcgatgcctccgccggcgctagccctgccggcgcattcgccgaagagtcgcatccgccccggcgtccccgctgaggcaactctatccaaacttctctaaaaagtccacagtttcagcccgtttttaatccaaacgaaaacttatggacgcaatacgttttgaatttgttatattttgtaaccttggcgcggagaataaaagaggcggcgaagcccttcgccgcccctcattgaatctgcttctgcccaggctgcttcgccagataataccgcttttcaaactgcagcagctggccgtccctcaccatccgccgcaggatacctgccgtcttgcgctttccgacgtgcaggagctccgctacatcctggcagtaggcaaaccccgcctcctgcagataggctgagatcacctcccactgcttttcctccggcaccactgttccggggagatagtatttcttgcccacctgctccagctcccgccggccaaccagccggcgaaggcggagatatgccgcagtgtccgacagattcagcagcgccatcacatcccgccgggtgatgctgccatgggcccgggtccactccagcagggtctggtcgtcctcccgctgtccgcctgccgcccggatgtcccggagcgtgatattttccagacctccccggatcagcgccgtctgcaccaccttggacagccgggccaaatccataggccgccgggactggggggagagcagcacatggggatcctccccaggggagcggaccttctgcactttttccagcagccgccgcacggcattggtcagcagcatgtcccgctccggcagatgcagcagcccccgctctaaatccacctggtcccaggtgagattcaccagctccttgccctgcacgcccatttgccagctcatccacagagcaatgcccgcggcggagctgtcctccttttgaaggacctgccacagacggaattcatcgaattgctgccctgcctgtgttgaacgctttttgtgcggggtgtctccggcaaagcaggcttggaaggtggagaccgacagaccgctgacccggacggcatagggccagtcgtgctgctccagctggcggaaaaagtagtcccgccgcagatctttcaattggagctgaggcaggcctcccgcagtcagggcatttctggcaatgcgggagacggactccggccgcagaggttcccggaacttatcggagatcaccacataaggagacaccgcgccgccattttcgaagcgggcagcgaggcatccggcagtctcttcctccagcgggaccgtccggtcctccagaaacagactcctctcctggaaatccacttgggcccatttcagggcgacgatctcctcccggctgagcccctgaagccaggccaggcggaggatgagccccggcaggtcctccggatgctggtgcaggagctggcgcatattctgttcatccggctggcggaactcgtttcgcataatgcctctcttggcgggcggcggcaaaaggttatccttatgtaacaaatcagaagaatgatttggatttccggataacgcaaacgctgccctctcccagccaatggctggaaaagggcagctaccttttatcatccttcaccgcttccgcaaaaactaagtatattacacttagaattataagcataacatttcgtttaagtcaagcattattatgcgtaaactgatgatattatattgaggagtatatcatcatgcagggaaagaagccgctgaacatcgcaatcggaagacggatccagcagtcccgggagcaagctgggctgacgcaggaggaactggcagagcggattgaccgttccacgcagttcatctccacaatcgagcgggggttggccggcccctctctggaaactgtgattcatctttgtgaagttcttggaacctccacagagtggatcctgcggggcagggccctccttccggactccaatctgctggcagcctccgttatggaaaagctctccgggctctcccctgcccagctgcttctggttgaccgaatgaccagcgatctaatcaaattgctgcaaatgaaggagagcggtgacgaatgagctcctctccctccaatatggaggaattgatagacgcatcgccttccccgcagcaccgctgcatgaagttcacaggccggctgcaaagtctatggccgttggcctgtcaagataagaccgggagccattctccggtgttatgccccccggagatcatcagtccggaagtatatcccatcggccagccgctctttacaaacgcttccttacacagaatgctgaaacatagaattccttagaacaagaaacgctcagatgggtgcatagaagcagctcctccagcttacagcgtgatccgtacagcaaaagccagcaccggacaggaaatatcttgcccggtgctggcttttgtgcttctttactatctctgcttgaggtgggtctgtcagaaccatgttgtctgtccgcagcagctctgcccggctttttcagggcctttcgcccgggtcttcaccagagtgctcttatcggatgcccgttcccatttctggtacatatctgatggtatgccatctctcacatcagccatctgctcatgtccgccattattcacgctccgccttgctatgcggctgaagagccgtgggatgctttgcctcagaatacgccctgctccatcatggcctcagccacccgcttgaagccggcgatgttggcgcctgccaccagggtgcgccggagtgtaaaccggcgccttttgatcttgtgcccactctggctggagtctgcaaaagtattcctgctctgatggcggcaatgcagccccccctttcaggacggcagttcttttctgcccagaaataatgaaacaggccgtcggctgcagccggcggcctgttttcagtttctccggttattgatacagcttcgggatccgaaagctctgctcgccatttgcctcatccgtcacggttccggccgggaagtaaatcaccggatttccctcctcgtccacctcgaacttcgtggtcccgccgatggtcacatagtcgctcaacggcgtgttgtcctcaatcgggaagtagcggacctccgggtccttgtccatgcggttggccatctgcatcgtgatcgtctccgtcaggtaattcacatagtcctctcccaggagctcctccagcgtgacgtcctcctgctgggcagacggttcttccgtctccggcgcagccgccgattcctgcggcggagtctccggatccgtcccctcactctccgcggcagacgcgccgcaggcagtgagaagcagcatacagagcagcagtgtgaggagcgtggaaatctgcatccgattctttttcatgatgaattcctccattccatattcatccgcagcacccgtccgggcgcctgttcccttttgataccgataccataagccctgtttccggcaaagcagccgcaaaaaggcatcattgttgcatcatttcccttctgcggcacgggaggccggttccttcccggagaggtcccacacaaatcccatcagctccacactgacgcgcccgctgcggccctccaccttccatctggggccgggccgtactgtcagatctccagcctgagacctctgcggaaggcctgtccaagcgcttccgccgtgcccagggaaccccttgccgagcggagtgtggagtcgatccacaccggcagccccgtgcccttgtccaccatcatccaatggtcatcccggtgctccgggccgccccgcaaatacagcataccggcggccagactgccgtcggcctggatatacaccacgccgcctccgcctaggccttgctatgctcctccgtctgttccagcagttgggtggcggaatagacgtccagctccggataccggatggtcctgcccagcagctccagcttttccggcagcgacgcctcccccgccgccagccgccttttgtcccctgcggaagagcaggtcagtaatttattcccacaatggccagtctgccatcgacaacactgaacaccacattgggcctgccgctggcggacagggcaaatcctgccttgctgggggccagccccccggggtccgccccggcgatctcagagaccagctcttctgagaagatccggtccgcttccagtgcgatcaggtcctcccgggactccacagattcccctccatcggaaaagccgatgtacagcggatacgacgccaggtccgccagcgcctccagattcttttccgccactgcggcctggatctgctctgcaaatgctgtaacagcctccgtatctatggaaaaattatctgtatactggggcgcttccgtatccgcaccgtcctcctcaggggtccggcccccatcttctccagcggtctcctccgcgggctgctccgcctgcggagagctgcccccctccggcgaggtactgccgctctggccgcagcctgcgagggacaggcacaggagccctgttaatgccaagaaaatgagcttcttctgcatcgtttatgatcctttcctcaagatgtttgccggcgtcatcctctgtgggactccggctgtcttataagacgccccaaagggcaaaaaagttttggcggccgcttttcctcttccacctccggaggatcacgcctccggaatgtcgccggcgcgaccgctggccacgaagagtcccgatgcgccatcggaggccgtcaaaaggccgtgggagaggcaaatgcctctcccacggcctttggggaatcaaattctgccagagtacgcgcttacttggtcacctcgccgccgggggcagagtgagccgtagaccaggcgtgctccagagccgcccagtcgcgctgttccagcttctccgtccacttctcgaccttgtcaccgctgacggtcacccaggtgtagtcgtggctgttggtcgcctcctgcatgtcggcatagaaccagtcctccggattgttgtcgggccaggtgatcatctcgtcctcgtccagcagccgatcctcatccgggctgcggcccagggcgcggttcacgatcacgcaggcctgtgcccgggtgatgttggtgttggggcggaaggtcccgtcattaaagccctcgatcaggcccacgcgggctgccgcctctacgtactcggtgtaccaggcgttaatatccacatcggtgaagtatccctggtagtcctcccgggtggtctcgaaaaagcccaccgcgatcttggcaaattgggcgcgggtgatcttggcatagggccggaaggtcccgtccgagaacccgtcgatgatgcccatgttggtcagggtggagatggcgttgttgcaccacaggtcggagctgcagtccgtgtagtcgttgacctggctccagtactcctcccgggtgtcgtccgtcagcaggcggaagaagatggtggccacttcgccccgggtgatggtgccgtagggctgcagcgtgccgtcggagtagccgatgatataggagtaatggtcctccgtgttcagggtgggccggctgccgcctccaccgccgcctccggtgctgccgccgcccccgctgctctccttctcgtacaccagcacgaagggagagaagctgccggcagtgaagaccagatggtcgccgtcgcgggtagcttggatcttttccacagtatgcgcggtaccagccaagtcgcctgtgtcgctggcgctctcacggtccatgccggtatagtgtaccaggtagaacgcgccgtcctcgtcggcgtcggcgggcatgggccagtagatggtcagcgcctgctggttgcccagggttaccacggtgttgccgttctgggtgtccaccaggtccagataggccatctcgtactggggggcggatagcgtgttgtccgtggccgcgacttttgcaagggcgtcagcgcccatggcggcgtcgaacgcgtcgctgttggagacgctgtccactagcagctgcacgcggccgggatccacctggacctcactgtcattgacataataggtcacattgccgttgtcaacggcagtgatctggttcgcgtccacagtgtcggcgctggtcacgatctcgttggtggaagtgccctcgtctgtgacgctcttgaccaagagatggccggtaccgatatcaacgctgcagacgagcgtatcaccgccggcggagaacaccgcctgaatctcgctctggttcagaccgccgtcgtagatggtcatctcatagttggcagaaacaacgccctcttccattcggatgttgtcggtagtgatgatgttgccgtcatctgtgaactggagccggaccttgacgccttcattttcaccctcgatttggttcgggctcaggctatatacatagcggctcacgttgccggttgcatctctcgagtagacgccctggtccatcagatcccagcggcggatcgccgcaccagtctcctggtcataatagtagaagctcaggtagtccgccaggtttgcagcctgcgtcaggtccacgccatggctggtgagccacgcttccacagagtcgggcagatcgatgtgataacccggctccggcaggccctgttccgtgctgccgacaaaatcgcccgcatcgtccagcacaccgctgtatccggttccgccggtgtagatcacaatgtccgccggcgtgatggtgatggcatagggcttcacctccacggggtccgccgggacctccaccggggatcctccggatgttccgtgtccgtgactaccacggtgttcacgatcttctggttcacatcgtccagtgaggtctgatagctggcgtacagcgttgcataggtccagccttcgacaataaccggattggtgaccgtattgccctcctcatctgtcagcgtcacaccttccaacttgtcagtcacatccagggtcaacgtctcatccgtcatgctggcaatggtgatggtccaagtgatgggatcgcccacggtgacagaggtctgatccggctctttgatcaccataaaacggccgtctccgggatcgggctcgggctcttcgggagtcgcctggaaatcccagcgcccgtacaaagtggtgtcggcatcgatggcagaaatcgttccgccgtaagggacaccgactttgtcataccagccgataaaataccaggtcccctgctcgtctgaaacctgcaattcactgggcggctgaatggtgtaattgctgccggcagccagtgtttccgtttcaggcagttccacgccctccgggtgatcgccggcccacgcataggtaaccgtgacctgggtcggcacgacccctgcggggtggaaggtcacaacaaagagatcccaatcctctaccgggtctccgatcttcggagcatcacagtcctcatagttgcaggtccagctgggatccccatagcctgtatcaggtgttgcctccaagatatcgccttcggccaggcgatacttgccatctgcattaacctccacgattgccgtgtaggtggtctgctcattgctgaacgtgccgttttccgcaaggaaaatcaccgagatggtattccccggctcctctccagctttctggaacttcgctgtgaaggtggtgtcctcgtcgtagggcaagcctgccagggacttcattcccgcgttcgtgtcagttctatgatagtagtcatcggtccactccacgaactcacagccctcttctgctgtcgccacagctcccgtcggagaggccatgccggtcgtctggtctctggtgacgacttctttctccaggcttacaaagcccatagcgtgatcggcactgacataggtgaagacaatctggtccttgtcgggggtcccgtcgggttcgtcgtcgggacccagctcgtcgatgtcatagtagacgtcgatggagttatggcctgcttggagagtctcaccgtctacaatctcgacatcgttcagttccgcccggtcaaagatgtatgtgctaccgttataagacgtacggtcagtgttatacagcccgctgaccggcgtgcctgccgtggacggcctatccttgggatcggtctctgtttcttcattcccatctcggtccacataatggtacacgacagtgtatgtgcactcgtcgggcgtcaccgtgccgtcggtggttgcggtgaagacaacgttgtgctcaggcatgtagaacaggccttcaataatgtcgctttcctgaaggtcatttgtagtccattcagtagcgtcttctgcctgcttcttgattacaacggtttccccgtaggtgtaggactctggttcagcgtagagagtcccgtccagataataggttacggtaaattcccgttctgtgcgcgtatactccgctctatacgtaatgtccccggttacagtatccgctatttcaggagaccatccggtaaactcatacgaataaagttcgctgggttctttagtcggatcctcaattctcggtgtcttatcgccgtaagccagcccgggaaatacggtctggggacttgttgttgtgccgccattcaagtcgtaagtcaccgtatagctgttgagctgagagaagctgccctcgatcacaacagcatgatcggtgaaaatgctactaataagagtaacaaagggtaaaccccttgttactcttattttttatgaaaaaacggaggtgaaaggaccatgagcaacaaatatttgggacccgcggatcggcagctgattgcagagaagtgggccgcttatgcgtcggtgcgggagatcgcggccctggtgggcgtggcgcctaaaacaatctatcaggaattgcgtcgcgggaacaatggcaccctggacaagaacagccgccagtcatacaaccccgatctggcccagcgtcgtttccaggaaagcctccgccggcgcggaaagcccctgaacagggcgcgggccgccagtgaatgagggaccccaccgccctgggggcgggtaaatgcaaaggaggaaaaagcaatggcaaccatgatcaaacagacgaaagaggaaatcagctgggcggagatcgccagggccagagagatgggtgtgctggacaagctgctggcggagcgggatgtgatccgtttcaacctgcggagcggcaccgaggtggccatcatggtggaaaaggtggaaccgggccgggtgtggatgggctttgtggacggcgtggcagagcgtcccatgtatgagagcctgctggtgcgcccggtgtcctggaaagagagcgacgcacggaagtggtgcaacaccgatctggtccaggatctcccggaggacctggtgtccatcattacaccccggaccattcggcagacggtagaggacaaggagctggtaaccacggatctgctgtggctgcatagcgcaacggagtttttcgggcgtcggacatgggcctctggcgacgatcccacggaggagcaactgccggtctacaagaccgagcgggaccgcgtgaagatgtggaacgggcggacatggccgcattacacccggtccgtctatgcgtcgtacagcaacagtttctgccgtgtctatacggacggcacggccaccaccgacaacgccgacggttcgagggccgtggcccccggcttttggatctaatcgaacaatccagaaaaatcaagccccgcaaggggcggagaaaggagccggacatggcaaaacgaaaggaaatcaagtggcggtgggaagcccgcggcaccatgatcggacggcagaacgggatcatttttcggatttatcacccgtgggacatgccggagcgggaacacaccgtaagctgctacgacacaaagggatccgcaagaacgatcagcacggcgggttacagaaaattcacctgggaggaggccgtggagttctgccaggcaatcgcagccggagagattgacctggaggacctgcgggcggagtttgccgcgatagaggcagaacgggaacggcaggcgctccgcaaagccgtggaagaggccaaggagttccggggccacctggaggcggcgggaatttcatacaacaccctgctggaactggaggcgctgcggggaaacctgggaagcctgggacacaacgcgctcctgggatttgaacgcggggagggctggccggatgggacctgacgggaaaggcaccgcccaggcagcggtctacatagacgggcagccggtgcaatacgccggagaaatcacgctaccggagatcaccgcagcgccggaacagatggagagcacggaggcaccgccgctccttgcgtcaatgggctttacggtggagcagttcaatgaagcggcccgctttatggcggaagcgttcggcattttctgcgacaagctggcggaggccaccagagcgatggtagacgcatgggaggcgatccgggcggcagaggagttccgcaaggccctgcggtgggcggaggcggccaacaggccgctggccgcccgctaccaccacaccaaaaagaagcggatccgcaagaagtacgcaaagcggatcctggcctggtatcgggaggagatcctgtaatgctgcgactgaaagccacaaaaaccagtttgtacaagctggtggcggaatttgtgccgaacctgcctcccatgcggagcgggaccagcttcaccaaatatccgagaaccccggactatgccctggactggatcacgcaggaatgggacacggcacatgcctttttctccacctgcatgggccgcccgctcctgtccattgagatcaggagcggagaaaccggaaagacggtgaaccgaaccacacacgccctgaacctccgggatctccgggagcggggcatggtggaggagttcatcacggcggcagagcgccggcgggtagaaaggagtgccgacaatggtggactttctcccgctacctgataaggaatacagcgtgatttatgcggatcccccgtggcagtatcggcagcacgggaccacggaaaagagccggggcacggcactgaaacagtacccaaccatggcaaccgaggatatatgcaatctgccggtgcggaaaatctgcggggggggggcagcctgttttctatgggcaactttcccgaacattgccgaggggatcaaggtcctggaggcatgggggtttcagtataagaccgcggcttttgtgtgggtgaaaaaatacgccaggagcgggaccaacttttggggcatgggagcctacacccgcgccaatgcagaggtgtgcctgctgggggtatcgcctgggtttaaggcaaaagagcggatccgcagccacaaggtacaccagatcattgaggcccctttcgaggggcacagcaaaaagccggatgaaacgcgacggcggatcgtggaactgctgggggatgtgccccgcctggaaatgttcgcccgccagagggcggagggctgggacgcctggggaaacgaggtgccgccggaagaaaggacgatcaaataaatgaccgagcgggaaagactgctggagaagctgggaaaggtcaaggccatggcggatcgcggcgagggcggggagaaagagagcgcggagcgcaccctggccgcccttatgaaaaggtacgggatcaccgaggaggacctggaggacacaaaggccaccattcactggatccgctacaaaacggactgggagcgcagactgctgggacagctggcttatatgcacctgggtacgggccattctttcgggtgcatgggtcaatacacgggaagatcccggaaaaaagtggggatcaagtgtacagcggcccaatacatcgagatcgaggcagattttgccttttataacgaggccatgaaagaggaaatggaactgttttacagcgcgtttctccagaaaaacaggcttttcccgccgccggagctggccgcggaaccaacagaggcggaaaaagaggaatgggaagatatggaacggatgtggaagatccactccatgatgaacgggatggaccggcacacgcgacacaaggccctggaggccgcagaataggagcagaccatggacaaaagacaggggcgcccggccaggctggagatcggaatggtggtggtgcggacgccgcagacaatattcgaggaggagcacggaaaggagatccggcggcccaggcaggggcaggtggactatatccacccattgggccggtttcacattgtggcctttcgtgttcgcgggaaaatcatcaaggaaacctttcagggtgtggaggtatcacaatgaattttttggaaatgaacggactgcaaacggcgcagacccatttcaaggacatttttcaaaacaatatccaccgggactatgcggacgccatgctggactggctggagcaggaaacagactttttcacggccccgtcctccacgaagtaccacggggcacaccccggcggcctgcttgtccatagccttaatgtgtactaccgcctgcggaatattgcgatccgcgatctggcggacaaggaggatccggggaaatgccgcctttcggaagaacaggaggaaacggtggcggtcattgccctgctgcatgatgtgtgcaaggtgggctgctatcacatggaaaccaagcggcggaagaacccggaaactggccgctgagaggattatgagggatatacatacaaggaccccctcccctgggccacggagagaaaagcctgtacctgatccagcgccacatggtcctgctgccggaggaggcgctggccatccggtggcacatgggcgcatacgatgacgcggccaaggcagacagccgcgccatggcggcggctatggcggcctccccgtgggtgtggcgtttgcaggaagcggacatgtgcgccgcctggatcgacgaacgggaggccgggcaatgaaaaaggagctttgcaagccatgtgccattgccctggagaaccgcggaaagaccgtaaaggccgccggagggcggtgtgagaaaatcacctgcgcggaatgtggccgccggcgtttcgggtacacctacgaggtgaccggctggccacaccgcaggaaaaaggaggacatgctgacatgagccagagaaaggccaaagaataccgccgcgccatggagcagtacaacggggtggccgaggatgtggacgatctgaaacgccgtgtcggagcgttggaggcaaggcactaccgggaggaccgcgacaaggcggtggacatgatccagcgccgtgcggcggcaaaaaagtgggaggaaacggtaaaggcaagaaccatgaaaaaagcggagcatgagcgaaaagcacgggcagaggaacgccggcggcggatcgcaaggcggaggctgatcaccctggccctgggcgcgcttgcggtggtcatgctcctggcctccgtgatcatgaccatcacggccaagccggcggcggaagccgcagaggcagagatcaccggcgccgccgttacttccacgccggtcgccctggtgaccgcagagccggacatgtgggacggcgagggagaggatccgctggaggcggagaaaatcgaggaggccctgctggcctccgggtatttctccgtggcggtgcctatgtgctacgaataccaggactacatgcggacctactgcgcggcctatgagtgcccctatcccctggccctggccgtggcagaggttgaaagccactttgatatgggcgcggtgggcgccgccggcgaggtggggatcatgcagctgaacccaggcccggagaatacatactggatcaacctggaggcagaaaccgagctggaccccaccaccccctccgggaacattgccgccgggtgctacctgctgggaatgtacatgcaggaatacggggacgcaaacaaggcggctatggcgtacaacatgggagtgagcggagcggaaaatgcctgggcggagggtatcacctccaccgactactccaccgccgtggtggaagccatggagcggtgggaggtcacagtgaacgcatggaatgggatataagccgggcaggaatacgggccgcggcagagcggagggcacggatccaccgctggcaggcaccgggccgcgccagagtggtacacccggcccgcgggtccgtagtggtcccgcacagttcaaacctggcggcgatcctgaacgcggcggaggtatggggctgcgactggacggagatccgggacgcaaaggtgtgggcggcacctggagaaaaggcggtcccaatgcctacattatataaataaggaggcggagcgaaatgctgatcaacgaaagcggcctggtgcgctgtatcaagcgggcgtataggtccgccgggtacgcggtggtgacccaggacgatagcatggcaatctacacggagcaatggtatgtccagtgcaagcgggcggccctgccccgcaaggtgctggccacaatcgtggaacacatgggcatgataccggacacggcgcccatgtccatcataaaggacggggatccgcagctgatcatgccggatgtggccagggacgaaacttcacactggagaaccggggaacgcacagacacggtgaccatggccaccgtgatcatgcagggttaccagatattccagccggagggcggcggcgcctgctacggcgtgagcctgtccgacctggagatcatggagcgggaaattgcagagcatgggcaggcaactgtggtagacggggaccgcctgctatggtgcggggacaacgaagtggtggccctggacaccgtgagaaaggcccggtcaagctgggcaaaggaatgggagcgggccgtatggaacgccatggagggcgtggatctccataaagaggaggcgtgacaatgccacagacgaattttgaccggatcaccgcctccccggaggtgctggccgctttcctggcctccctcccctgcctggaagccccgtgggatgacgctttccaccgggttttctgcgacaactgccaaacaacggactgcccgcaggtatgcccgcatgaagcggagcggaacagcccagcgtggtggctggagctggaggtgcaggccaatggagaaccgggcttttaatatggattgcatggaggccatgcgctccatgccggatcaatgtttcgacctggccgtggtagatcccccgtatgggatagatgcagccaatatgaatttagggctagggaaaacaaagaaatgttcaaaaattcaaaaccgaaatttcgggaaaaagggctgggataaaaatattcctccagaaaaatactttcgagaattagaacgggtatcgaaaagacaagtcatttttggagggaattacttcacaccatttcttgaacaagcacatagaggatggattgtttggtataaggggcaacaagggctaacaatgagcgactgcgaactggcgtattccacattcgacacaccgacaagggtggtgattataaatcgagcacagtttcaaaaagaagggtttaagatacatccgacccaaaagccggtggccctgtatgcctggatttttcaacactacgcaaatcacggggaccggatcctggacacacacctggggagcgggtcaagccggatcgccgcgtgggacgccgggcttgattttatcggatacgagatcgaccgggagtatttcgaggcccaggaaaagcggttccaacaacacaccgcgcaactgtccatatttggcgagggagtatctgatcacaatatacatttttagggaaatgaaaaccacctgcgcctggtgctgataacacggcgcaggtggacagatacgaggcggcgcggaggccgtcctggatagctgtattatagcatactcccggacggcctgcaagccgcaaaatttgacggggctgcggccccgtatagctccggtaagagcaattagtaaagtgaccagcagaccaaaaggaggagaacaccatggcctatgtccataggcgggtgaaagctggccgcaccatcgaacacaggaaaatgcagtcataccggatccacaccaagggggtccagagggggccgaaccacgggaccacatcggcaaagcaggccaagatcaacgagcgggtggcagaggagcacctgcgctgggacctcaacgccaattttggccaccgagatctccacgccgtcctccactactacgccaaggacaccagctttgaggaaatcctggaacacaaagccgttttcctgcggaacctgcggaagatctgcaaaaaacgcgggatcaagtacaaggccgtggtggtcatcgaaaccaaaaggatgacaaatccgcacattcatgtggtaataacgcacatggacccggagatcatcacggaggcgtgggagtttgtgccgaggggcggcgggggcgtcagcttcaaaccgctggaccgccgcgggaaccatgcaaagctggcggcctatctggtcaaagaaagccggtcaaccatggagaagtaccgggagatcgggaagcggggcaagaggtacagcaaaacacaaaacatggccaagcccgtgattacatacaccaccgtggccgcttcctcctggcgcaaggagccgaagccaagcaagggcgccgtgctgtacatgttcgatgacggatccaccacgcggagcgggtggcatgaaatcagcggttacccataccaggaatattttgaggttttcaacgaataggaggacgccatgaaaatttaccttgccggcaggatcgccggggatagaaaataccgggcaaagttccgggaggccgccaaggcgctggagggaatggggcatgtagtcctaaaccctgccaccctgccggacggactgacagacgcggactatatgcagatctgcatggccatgctgaacgcggcggatctggccgtgttcctgccggactaccgggagagccgcggcgccatggtggaatgggcgtactgccagaggattgggaaagactgcgccctatacatggacatgacagggggcggcagacagtgagcaaagcgcagatcagcatgtgggaggaaaagattgtggacagtttcgccggcggcggtggagcttccacgggaattgaactggccacgggccgggtggtggacatagcgatcaaccacgatccagacgccattttaatgcacaagaccaaccacccgcacaccgtacactatcaggccagcgtgtgggatgtggacccgctcgaagtcaccggcggcagcccggtgggcctgttgtgggcctcccctgactgcaagcatttcagcaaggccaagggcgggaagcccgtgaacaaacggatccgggggctggcctggatcgtcctccgctgggctgggacggtccgcccccgcgtgatcatcctggagaatgtcgaggagttccagacctgggggccggtacgccgcgggcgcccggtgaagtcaaaggccgggcagacattcaagcagtttatttcccaactggagggcctgggctatgccgcggagtggcgggaactggtggcggcggactatggagcgccgacaacgcgcaagaggtttttcctgatcgcccgctgcgacgggcggcccattgtgtggccggaaccaacccacgcgccagcgggcagccgggaggtgctggaggggcggaaaaagccgtggaggagcgcggcggagatcatagactggagcctcccatgcccctccattttcgacacgcgggaggaaatccgggagaaatacggcctttccgcccagcggcccctccgcccaaacaccatgcgccgggtagccagaggcgtggacaagtttgtgatcaaatccgctgccccgtttatcgtaccaatgggctacggggagcgggacggacaggccccgcgagttcacaatatcgcagacccagcacccacggcggtggggaaaggcaagcatggagtttgcggcccggccatggtgccgtggacggtgacaaacaccaccaactccacggggcaccccgtcaatgagccgatagacacggcacggaccggcggcggaggcggtcaaatgtttttgggggcctccctgatccagtatcacacggagcagtcagaacatgtgagaggccaggagatcaccgggccgatcatgaccattgacgcagccaaccgctacggcctgacggcggcaagcctggtcaaatactacgggaacgaccagcacggccagaacatccgagacccgctccacacggtaatatccaaggaccacgagggcctgacaactgcgcacctggtcaagatgaaaggcaccaacctgggagggcctgccacggagccagtgcagaccatcaccgccggaggaggccatcatggagtggtcaccacgcggatcacaagagcggagccgggcgcggatctcaaacactggccggagatccgggagctgctgaatacatattgcggctatgacctggggccggaggatgtgatcctactccagatcggcggcgtatggtatttcatggcggacattggcctgcgcatgctgacgccgcgggaactgtaccgagccaacggtttcccggatgattacaagatcgagcgggactataccggccaaacctacgggaaaagcaagcaggtggccagatgtggcaacgccgtgccccctccctttgccacggcgctggtgcgggccaacctgccggagtggtgcgcaggggtggagatcagcaccatggaggaactggaaagggcggtggcggtgtaatgctggaaatcgtccccatgacattgcgggaggccaacgcctttgtggagcaaaaccaccgccatcatggcccggtggccgggcataaattctccatagggctttcggacggagagcggatcgtgggcgttgccattatagggcgcccggtatcacgccacctggatgatgggtggaccctggaggtaaaccgcctttgtactgacggaagccgcaacgcctgttccatgctgtatgccgcagcgtggagggcggcgcgggcaatggggtataagcgcctggtgacatacatcctggagagcgaaaacggagcaagcctgcgggcagctgggtggaaatgcgtaggacaggccggcggcctacgatggaccggacgccggaggccggaggtagacctgtacccagcacaaatgaaaatccgttttgaacggacggcggaatgaggtggagccatgaacggaaagaaaaacatgcgccggatcagcgtcctggtgaccgcgcagacggcatataacctggacaaactggcggccatgtgcggctaccgggagcggggccatgtgatcgacaagctggtgagagaaaaaatgctgcaactgaacggaggaaagcgacatgaacaaaacgaaaattgactgggccaccatgagctggaaccccgtaactgggtgccgccatgggtgcccatactgctacgccagacggaccgcccgccgctttgacgccgggtgtgcggatcctgccccgctgcctggcggcctccatgtgctgacggagaaaatcaaggccacgccctacccatacgggtttgagcctaccatgcaccgctaccggctgaaccagccggagcgccaggaggagccgcagacggtttttgtgtgcagcatggcggacctgtttggcagatgggtgcccacctcctggatcgtggaggtcctggacgcatgcaggcgcgccccgcagcaccgctatttgtttctgaccaagaacccggccagatacctggagctggaccacatggccctgcttccacatgagagcaatttttggtatggcagcaccgtggcaaacgaggacgcagaagccatgtacaccatgcagggggtggcaataaacagcttttggtccatggagccgctgctggggccggtggacatgagcaaggcggagggactgccgcaatgggtgatcctgggagctgaaaccgggaaccgccgggaaaaagtggtgccgcggcgggaatgggtggatcagatcgtgcagttttgcgcggagaatgagatccccgtgtttttcaaggacaacctccgggcgcacttcccggatctcccgccatccactttcccatgggatgaccgagagagtaaaacggcaaagtgggccgccaacttcatggggcgctttgaaaggcaggtgtgaaccgtggacaaaatagaaatcggctacaccgtggaaaaagagcggtggctggaggccgccgaaaatctgcatgagtttggccagatcatggcgcggaacctgcggaacatgaaccgggacggacgcggacaggaggacgcggacgatcttatggcggacattatgctggcctgtacagcaatcggctatgtggcggagtttgccgtggatcaatgccggtttatccctatgccgggaggtggtcagaaatgagtgaacagaaaaggccggagatctgcgagtattgcgccctgggtgatcacgacgcatatatttgcgcccgctggcgcctgtcctatgccgtgaatgaactgaaaaaggcggtcccgctgctgcggcggacagcagaaaagcagatgaaatgcccgtactactaccccgccggcctcctgaaaaccggcctggtcataatggacgaaatcgggccgtggccgccggagagaaaggggagctgatcatgcgggcggtgcttttgagcataaagccggaatggtgggagaagatcctggccggcgagaaagatctggagatccgaaaaacggccccgcgggccggagccggagggccggagccgtggccgctgctggtcctggcctatgtgagcgggaccggggcggtgctggggcagttcctttgcatggggtgggtaaaaagcaactgttttcgctatttggcctcccgctcctgtgtgccggcggaggacctggagaaatacgccggcggaaaatccctgtatggctggatcgtgggagaggcggaggaatacgaaatgcccagtccgctggcggagttcgggctgacccgcccgcccatgtcgtggcagtacatagagatcccggacgataaggaggaatagggggacgaataaatggcaatcagtctttcagacctgccgccaaagtatcagcagcaggccatggaaaaatacaggaagcaacagacgcggcgggggcctatgccctccgccgccgatgtgcaggatccggggaagccgatgaagtatcgaaacaaccccaccgagcgggtcacctcctccggggccgtcatacgctttgacagccagaaagaggccaggagatacgaccacctgatcctccgccagcaggccggagaaatccgggatctgcgcctccaggtggattttactttgcaagaggcatacacggaccaggaggggcggaggatccgcgctatcagatacagggcggattttacatacagggagcgggacgggcgcctggtggtggaggatgtgaaaagccggccaaccaggacgcgggaatacctgatcaagcgcaaactgatgaaagaacagcgcggaattgacataacagaggtgtgagcatgaaccagcagacaacgggcggggctacccgcgaggccgtaaaagaatacttgcagcagtaccacatggcgagagagcgccgccgcatgctggagcgccgccatgatgtgctggcgcgggagctgcgggcgccggcacctggatccacatacatgaccatgccggcctcacaccccgcagcggacagcgagggggccgtgtccgttgtctttcggcttgcggaggtggaggaccgcatagaagcccagcggaccgccatgggacgggccgtcaccatggtaatggatctcattgacctgctgccggagaacagcatggagcgcaccgtggtggagttgcgacacatcgactgcaagaaatgggaacggatctgcaaagaggtacacatgagcaggtccagggtgaacgactactacaacgcagccctggacacgatcctgtccaataagcgggcgcagaaattggtgcaggattttgagcaggacaggggacacggaaccggcggagaaaaaagtgggccaatttgaaaagttcggacactatcggacattcgcctgtgttatgctggtatcgtggaaaaacggcaggggcaagagagcagaacccccgcaacatagagagaggccgccagggcgtgaagaacctggcggcctctgtgttttttcacaccatgggccggggagcagaaccgcaggggcttttctcctttcaccctgtcctgccgcattgtaccagagtgcggcgggccggcccgatccgggtggtgcccagggcctcctatgccgatggggtggccctgggcgcaccggaaaatcacaaccacctcccccgtttgggtcctttctggaaaataaatctttgcggggcaagtgaagcccgattattttccgcaaaaaatccaaaattttcaggggtgtttcgttacgcatttactaaaagcggggaaagcataccccctttagggggtatgggcaggaaaaggagcggtaaaaaacgcgaaatcgtccgcggcggaggatgacaaaccgacggagcgggacgatccgggccagcggcacaaaaggaggtgcagccggtggcggggaaaaagagggccggaacggccaaaacaggagcggacagcaaggcggaaaaagcgccggcggccctaactgctgtcccggaatgggcaagcaccacggcggtggccaaactgctggggaaaaccacccggcggatccagcagctcacccaggacggtgtgctggaaaccgaggtgccgcccggcggcggcgcccgaaaatataaaacctgcgaaacgatccagcgttatattgcccacatcgagcaaaaggcccaggaaacggcggcggccagctccaccgcggagctgaacctgcggaagctggaggcggaggtagaactgaaagaaagccagggccagctccacaagctgaaaaccgccattgccgaggggaaatatatcaaggcagaggaggccaccagggatctggcggacttcatggccatgtttaagaaattcgccatgaacatcccaccccgcgccgtgaaatccatagccggatatgcggacccgcaaacggccagggccatggaaagggcaatgcgcaaggagctggaggatatgctggccgtattcgttgacgcggcggagatcggaccggaggaggcagagccatgaggccgtacagggtaaagccgtacacggtgccatcgtggatccaccgggcgctcctgtccctgcggccagcggaacgcctgccggtttccaaatgggcggagaaatggcgggtcctgcccgacaccaacgccataccggggccattccgcaacagcgtgaccccgtatctggcggagatcatggacgccttttccaacgaggatgtggagcggatcgtatttgtaaagcccacccaggtgggaggcaccacggccctggagaatatgctggcaagcgccattgaccaagacccagcaccgactatgatcgtctacccctccaaggaactggcagggcggacggtggaggcgaaactggagccgatgatccggcaatgcaaaccgctggcagccaagtaccgggaggcggaaagtcaaaagctaaagctgaaatttgaaaccatgttcgtttttctttcgggagcaaacagtccggcatccctgtcctccaccccgatccggtatctgtttcttgacgaagtggacaaatttccgggagcctccaaaaaagaggcggatccggtttccctggccatagagcgcaccaagacctacaccacaaaccgcaagatcttcatggcctccaccccgacgctaaaatccggccatatctggaaagccaaggaggaggcagaagcggagaagcattatttcgtaccatgcccccattgcggtgagtacatcgaatttgtttttgcacagctgaaatggccgagcaaggacgatgtgccggacagcgccgagcgggcagaaatggcagcgtattcctgccaagcctgcggggccgtgatcacagaccaggacaaggggaaaatgctggccgccggcaggtggcagacggtccggcagaccgccgccaggccctccagcgtggcctattggctgaacaccctgtactcccctttcacgcggttttcagagatcgccaaggagttcctgcgttgcaaagatgacccggagctgctgcaaaactttgtcaacagctggctggcggagccgtgggaggacaccaaactgcgcaccaatgcggagctggtgctggaacggcagaccgaggtggaggcatacgacctgccgaaatggacaaagctgatcaccgccggcattgatgtgcaggaaaactgcctttactggacaatccgggcctggggagattacatgaccagccagaacattgcacacggacaggcgctttccatgaacgaggtggcgcagatcatgaacaccgagtttatacacccggacggacagcggcttgtggtgtccctggccttgatggacagcggagaccagacggatgaagtttacgacttttgcctactaaattcagattgggtgttgccaagcaaaggaaccagcaccatgctgtctaactatcgcctatccacgatcaacaaggcaggaagcaatgccaacggaatgacactggtactggtggacgggggaaaatacaaggacatgatcgccgcccgcatgaggaagccaaacgggcgcggatcatggatggtctacaaggactgcgatctggactatgcggagcaggttaccgcggagcataaagtgaccgagcgagtaaacgggaaagtggtgcagaaatgggtgccaaaaactacccatgcagataaccactatctggactgcgaggtgtacgcggcggcggcggcggacatgcagggcgtccgatccctctacctgcaaagccaagagccggagaagccaaaaaagccggagcctgcgccgacaccggaggaaaattggatccggcaaaatgaaagctgggtataaaacgggaggacaaaatggaaaacacgcagatgaagccggcggaaatgctggagcaggtaaataaagccattgcggcggtgctggtgggaggccagtcatacaagatcggcagccggtccctgacacgggcggacctgtccatgctgaaatccatgcgggacgatctggaggcccaggtggcagcgggcaccccctcccacctgctggatcggacctttgtggcctactttgacgggaggtgacggcagccaatggggtttctggacaacatcataaccgccatttcgccggaagctggctataagcgggaagcgtggcggcaagccctggaggagctgcgggggtatgacgcagcaagccatgggcgcttaaattccgggtggagggttttcaacgagagcgcggagctgacggaccgttacagccgggatgtgatccgcgcccgtgcccgcgacctggagagaaacagcgacataggccagtctgtgatccgagcgttccggcggaatgtatttggaaaggggtacaaactccaaccgaaaacagaaagcgaactgctgaacgatcagctggggaaactgtggaaacaatggtgccgcaaagaaaactgcgacataaccgcgtcccagtctttcaaccagatcatgcgcatggcagccacaagaaagcaggtggacggcgggatcctgttcgttaagagatacacgcggggcggcctggtgccgttcaaactccaaatgatcgaggtagacgaattggacaccaccgcctccataccgaggcacaagggaaacacggtggtgggtgggatcgagtacgatccggcccgtcgggcggtggggtattttatccagcaatacgatgtggagggctggaaactgaccaccccggtgtacatagaggcaaaatatgtgatcccatactggacaaagcggcgccccagccaactgcgggaggtgtcggacctggccccaaccattacgagggtgcgggacaccaacgaatttattacagccgtttccgtcaaggaacggatcgccgcatgcctggccgtattcatcaaacgcgcaaccccaacgggaggttttggacgcggcggcgtggtgagcaacggtgaccgtgtgacatacgagggaaagagcctaactcctggcatgatcaaagaaatgaatgtggggacagtatcgaaactgtggaaccaaagagcgcaggatcggacgcctcccaattcttgaaaatgcaatggcgcctgatcggcgccggccaaggcatgagctacgaggccaccagccgggatatgtcggaaagtaactattccagcgcaaggcaaggggcgaatgaggacgaagctacatttgccgaggagatcgagctgctgaccgagatcatgagcgagatctacgaaacctttgttatttcctgttatctcaccgggctgatcaacccgcccggattttgggataaaaaggcggattacatggcgcacaagtgggtgcaagcaccgaaaaagtggatcgaccccacaaaggaaaccaccgccacaaaaaccgccctggccacggggcaaaagacattccaggatgtcgcagccgaacagggcaaggactggaaagacgccataaacgaaatggccgaggtcctgaaatatggccgtaaagccggcattgagatggggggtgtaatttatggccaaggaacagcagcagaacagcagaacgcaggacaggaaccaggggaccaggtgcatggggcaaattctaacccgacaggaggaggggcaggacagccgcagacggacaattagcttttccagcgaggagccataccggcgctattttggcatggagatcctggaccatgcagccggagccgtaaacctggagcgcctgaacagcgtgggcgttctcctgttcaaccacgatgtggacaaagtggtgggacgggtgatccgtgcctggatcgaaaataaccgcggcatggcggaggtggaatttgacaccgacgccgacgcagaaaaagttttcggaaaggtgcagagcggaaccctgaaaaccacctctgtccgatacagcgtggacagctgggaggaggtgcgccccggcgccacatccgccgatggacggtttcagggaccgtgccagatcgccaggcggtggacgcccctggaggtgtccattgtttccgtgccggcagacgccaccgtgggcgtaggccgttccgacgcagacacggcaccggacctgtccgcatacgagcggcagatccaagtcaatcaaaacacttttaggaggtaaagagcaatgaccattcaggaaatgatcgccagacagcaggcgattgtgacccaggcccggaacgagggccggggcctgtcccgcgaggagcagacggagtttgaccagctccagggcaagattgacgctgcccgcgccgcaggcggccaggagggaacccagggcggcgcggagtctcccgcagacggcagccgcggcgccggggatcctgccggcgcagagggccaggacggcggaagcgacgcaaccagacaggccgtcgaggcggagcgccagcgcaacagcgacattgtggcactgtgccgccaggtgggcatggaccccgcagagcatatccgcagcggccacaccatggaccaggtgcgccaggcggcggtggacttcatgatcgcaaacggcggccccgtagcaacccggaccgatgacggccaggggaatgagttccgaaacgcagccgtggacgccctgctgctgcgggccggcgttcccgtgagcaatccggccagagaggcggagagcctgcgcggtatgtctgtgcgggatcttatgatcgagtgcatggcccggagcggcgagggaaccaccacttccctgctgcgcatgggaaagaatgacctgtgggacatggcggtgcgccagttcctttcccccacggcctctttccctgccattctggaccaggcgatccagaaatccatcgttcaccagtaccagaatgtgctcaccacctttgacctgtggaccagcaaggggagcctgccggacttcaagcccagcaaggcccatgaatacaccatcggcggcggggagttcgacaaggtgaccgagggcggagagctgaagcatagcagcctggacaccagcatgaacccgctgcgcaagctggacacctacgggacgcagttcaccatgacccgcgaggcgttcatcaatgatgacattggctttttgtccgaaatgccgggccagtatgcccgcgtggcaaagcggaagatcaacaagcaggtgtatgaggtcatcgtgaagaacccggccgtatatgacggtgtggccctgtttgatgacgcccacaagaacctgatctccaccggaacggcccccaccattgagagtgtccagaaaatgatgatgaagctgctgcgccagacggatcctttcggcgaaagcattatggtacagcccaaattcattctggtgcctgtggggtacggcttccttatgtcccagctgcttgaaaccgcgcaggttgatgtggacggaattggcagccacaccgcaaacgcgctgtacaagtaccggacccagctccaggtggtggaggagggcacaatcaatgccctggccggaaccagtgcggtgccctggtacatcgtaggcgacaagtccacggccaagagcgtccaggtggactatctgaacggcgttgatacaccgagtttccgccggagtgaaaaggccggttacctgggctttgtgtgggacatttggcttgattggggtatcaccgtcatggaccaccgcggaatcgtccgcaacaacggtgtggccatcaccgagtaaggaggtaaagatcaatgaacgcgagatattggcagaaaggcgaaaccctggactacaccgccaccaaggaggccgtgaccaacggccaggtggtgagcctgggaggccggatcggcgtagcgggaaatgacattgccaagggcgaaaccggcgccctgcatgttaccggcgtgtttatcatggaaaaggccgcctctgtgaccgtgaccatgggcgccgccctctacttcgacgaaagcgaggagaagatcaccacggtggcggcgggaaatgtccctgccggctatgccgccgcagacgcgggggcaagtgacgccaccgtgctggtcaatatcggggatcccaacggagcagccgcggaggtggccgccgtgcatgacagcctggcgctgaaagatacgagcgggaaagtgtatgacattaccgtgagcacatccggcacactgaccgcaaccgcgagggagtaaggaggtaacgggccatgaaaagactgattgcagagcggtccgtgctttacctggggcgcatgtacgccccaggtgacgccctccccgccagcgacgggatcatggtggcggcctggctgagagcaaagagcgcaaagtggaccggagaggccgcagagccgcagcagagcgcccaggaggacgcggcgaaaacggacgggtcccaggatagccagggacagaacgagagccaggagggcaaggaaaacggccaggaggccaaaatggtggagggacacctggatcccgaccaactgtccaccatgaaaaagtccggcctggagaagctggccgaacagctgggaattgatatttccgacgccaagaacaacaaggagcgggcggagctgatcgcgtcagccaccgtccaggtccctgaaaccgaaaccgggagcgcccactgatgggcgcccccagtttcaaggatcttgtggcggctgacattttcgatgtgttcctgaataaacaggagcatgcggacacccacaccatagacggaaagcccatgaccgtggtggtagatgaaaacgaactgctggagcgggacaaatcgaaaatggggatccaagtggatgggacatataaaagccgccgcctgatctatgtggccaaagatgaatatggaccgcgccccgcctacgggaaacagatcgactttgacgggcgattgttccgggtggctgattgcacagaggaggccggcatgctggccatcacgctggaggcggtgagatcgtgagcgatacgcagacaattttgcagatcgacacccaggcggagattgaaaaaatcatccggcagctggacaccctgcccaataagctgaaagcccccagcgtactggccagcgccatcaacgcgacggccaacgagatgaaaaagaaaattggccaacgagcaaggaaacgctatgcaatcagcgacaagaagatcctaaccaaaaaggaccgcggcgggatgtacctggagcgggccaccggatcctccagtaccgccacgctgatctccaggggtggcatggtggaggccatggcctacatgaccaggaagaacaccgaaacaacggcggccatgctgaaagtcctgaacgaaagcgccatgaccgcgctggaggtagacgggaggaaagcgtttcaaaccacattccaaagcgggcatacggccattgtgcagcgcgtaggccgcagcagattgcccgtaagatcccttatggccccggcggtcccaatgctgtatggaaagagctatgaggaggcggaactggattattacgccatcctgcaacggcacatccagcgagaagtagagcgggcgctgggcagtttcggaaatgcggcataaaaaggcggccccattttgcagggccgccgggaggtcagttattataaaaatcttcgctggtatatcccatttgcaaagcaaggaaatatatgtgcttgcacggtttactgcgcttttcaaaatcagggcatgaacaataatccagcgttgtggtgtatttggtgccggtggatccgctgacctctgcggtcccggtgtccacatcatagctgatcaacccaagacattcatgggacgccttttcaaagcggtccgactgcgccgcaccgcggtgtaccttttcgttccattccccaaacgagtggccaaccgggcaccgcctgctgcggatggaaaccaattctgtttttctgaccggaaacacaagcgaatacgaaacagtttcccggatcgtttcgctcccctcccgcccctctattgtgcggagttcgcttgtttccgggtgcccctttttccattggccatacgcggccaaggcggcggcaattacaacgccgccaccaaacgcttgaatttcgccggtgaacaggcacacaagcgccaagaccaaaaccacgccggcagcaatgtacaaccctttccctttcatttcatccacccttttcatacgccgatatgctgattattaccacaaaggtgattataaggcacaatcggtaacaagtcaaggaggcgcggcagcgtgacgcaagaatttttacaggacgccatggtggcggatctaaaagagcttttcagccatgaacggctgaaaaattccctgggcgtggagcgggagatccagatttacccccaggatgttccgatccgccggggggacgatgaagccatagacaaggaggcgccgccggagccgtatgtggtggtgcgtctccggggcggaaagacagaaagcgacgatgatccgcagatcatcgacgcggttttggtggcctgtgtctatgacccggatccggggcgccaaggctaccgggacgccttgcacatcatcaacaaaatttaccatcactattccgcttgcgccgtgatcggcaatcgctgggagatcctttaccccatggagtgggtcacccaagaggaggacacccacccgctttatctcacagcaatgtccctgcggatccaggcgccggcggtccacaaggaggtgccagaggcatgacaacaaagaagcaagcaaaggcggcggaggaggccggaaccctggtgtactgcggtccaaccattcccggcgtggccaagcagttcacattttaccggggcggcgtcaccgcggggctgaaagcggcccaggagcgcaggccggtgctgcgcgccctaaccataccgctggatcagctgccggaggccatgaagcagctggaaatgaaacatggccgcatttacgcactgtaccgcgaggcgcagaggcagaaataacaggaggtaaagcaaatggcaacctatcagcatggcgtgtacaaccaggaacaggccacgagcctgaccacgccgatccagagcagcgccgccctccaggtgattttcggaacggcccccattcacctggcggacgatccggccaaggcggcaaacacaccgaaactgtgttacagctttgcggagtgccaggccgccgtggggtattccgacgacttcgagaatttcacgctttgtcagagcattgatgtgaatttccgggttttcaacaatgcccccatcgttctggtgaatgtgctggatccgaacaattccaagcacatcaagcagaacgaggcgaccagcgttaatgtgactgacgggcaggcggtctacactgtgccctatgccctgatcagcaccatggaggtcaagaacggggacgccgcactggtgaaagataccgactacacggcggctcacgacgatgacggaaatgtggtgatcacactgatctccgagagtgcgcaggaagcggaaagcctgtccatttcctccacgagcctgaacccagccggcgtaaccaaggaggatattgtgggtggcgtgagcagttccaccggggcggaaaccggcctggagctggtgcgccagatttaccccaagctgggactggtccctggtattctgctggcccctggctggtccgacgatcccgtggtggcggcggccctccaggcaaagaccaccaaaatcaacgggaatttcgactgcaacacatatctggatattgccgccaacagctccggtgcaaccgtgtacaccgatgtgaaaacggcaaaggaaaaactgggcgcaagttccaaccatgcggcggttttctggcccaagggcgcggtgggcgaaaagatctattgcctgtccgcgctggcggcggcggaaaccgccaacaccgacgcaaccaacggagatgtgccgtttgaaagcccgtccaataaggccctgaacattaccgccaccgtgctggatgacggcaccgaggtggcgctggatcaggagcaggccaacctgctaaacggccagggcgtgatcaccgccatcaactccaacggcttcaaactgtggggaaacaacacggcggcctacccctctaccacggatccgaaagaccgctggctggcggtgcgccgcttctttgactgggatggaaataatttcatcctcacctactggcagaaagtggacaagccgggcaataagcgcctgatccagtccatcgtggacagccagaacatcatcggaaacgggtatgtggcccgcgactactgcgccgggtatcgcattgagttccgggacgatgaaaacccgatcaccgacctgctggacggaaagctgaccacacacacctacctggcgccctacatccccgcggagaagatcgtaaacatccgcgaatatgacaccgcggccctggaggccgcactgacaggagggagtgactaaaccatgagcaagaatatccccaccaaaatcaacaactacaatgtgtacaacgccggggacaagctgctgggcgtgggggatgaattgaccctgcccgacttcgaggccacaagcgaaacggtgagcggagccgggatcctgggagagatcgaagatcccacaatcggctatttcggaaacatgcagctggagatccctttccgaactctggacaaagaggccaccaacatgatggaccagaccagagcggtccagctgacgatccggggcgccgcccaggagatcgacagctccggcaacatcgtgcccaagtccatccgcgtggtggtcagcgggcgggccgcaaagctgaccggcggcaaactgaaacgggccagcactatggacagcggtgtgaccctgaacatcctttacatcttgattgaggtggacggggaaagcgtcctggagctggacaagatgaaccccacatacaaggtcaacggcgtggacctgctggcagagtataaggagatgtgctaaatggacgaaattaagaccaacgccgcccaggagccggcggaggaccaggaggagagcctgatcctgaaattcagaaagccgtatatgttcgagggcaaggagtacaccgaggtggacctgtctgccatggaggacatgacggcggaggacctgtgcgccatgggcaagatcatgaccaaactgggcattgtgaaccctgtggcggaaatgaccgtggattatgccatttacatggcggcccgcgcctccggcaagccggtggagtttttcaagggcctgccccccaaggagggcattaagctgaaaaacatggtcacgggttttctctacggcggggatggagaggactaaccccgccagaaattagaaaagcctgcgtggggctttcgttcctgctgcggacaggtgtggactatttcatgcacctgtccgtgcaggaattacaggacatagcggaggaggcgatcaaactgtatggcaagaggaaaagtctatgatctggcaatcaaaatcgccggacgggtggacagctccctgaaaaaagcctgcctggacgcagacgaacagctgggagaactggccaagacagcggaaaagatcggcaaagccgcaaaggtggccgccggagtgacaacggcggccatcggcgcggtgggcgtagcctccgtgaaagcctacacggaacaccagcaggcagccaacagcatggcggcggccaccggagccgccggtgagcaactggagtatttgcaggacgccatggacacggtgtacaccgacaactacggggaaagcctgcaagatgtggcggacgccgtgtccctggtggaccgcaacatgaaaaatatctcgccggacgaaattgtggaggcaacggaggcggccctggccctccaggacactttcgagtatggcgtggaggaaagcacacgcgccgcggcggccatccaaaagaattttggtggatccgcgaaagaagcatttagcctgattgcggcgggtgcgcaaaacggccttgactactccggggaactgatcgacaccatcaacgaatattccagccaattctccaagctgggatttacggcagacagcatgttccaactgctgcaatctggcgcggatagcacggcctggaacctggacaaagtgggcgacgccatcaaagagttttcaatccggtccattgacgggagcgacaccacggtggcggcgttccaagccctgggctacaacgccagcgacatgatggaaacctttgccggcggcggagaggcggcaaacaaggcgttttacgatgtgctgaacacactaatggatgtggacgatcaggtgcagcgggacgccatcggcgtttccctgttcgggaccatgtgggaggacctgggggcggaggccatgcaggccatggcggacgcctccacggcggcctatgacacccaaggggcactggatcagatcaattctgtgcggtacaacgacctggaaagcgccatgcggggcgtgaaacgacaggcggaggagatcctgtggaccatcggggaacagctggagccgtacatattagacggcctaaatttcctatcagcaacagttatccccaatgtgcaggccgctgtggaaaagctgggcggatatgtggaaagcaatgtgatcccggcggccaagaccgcggcccaatggatcggagaaaacaaggacatgctgctgaccctggccggagccattgccaccgcggtgggggcctatatggccctgaaaaccgcagggcaggcggcgggagccattaaggggatcggcacggtgctgggaacggcaattaagcaaggcggactactgaaaacggtggtgggcctgctgggcggccagttcactgtggtgattgccataattgcggcggtagcaggcgcttttgtgatcctgtggaaccggagcgaaaaattccgaaattccgttatggggatctggcagagggtgcaaccgctcattcaggcatttggaaacctggtgagcctgatcgccaccagtctggcccccgtcctggccaatttgggcaccgtcgtgctgggcggcctggaggcggcgtttgtggccatggccccgtacatcgaaaatgtgatcacaattctgacgaatttgatcgagtttatcacgaatgtattttccggcaactggtccgccgcatggcagaatgtggtaaatattttcggatccgttttcgggatgatcgtgaatttggcaaaagttcccattaacgcggtgatctccgccatcaactgggttatttccaagatcaacagcatatccgtgacgatccctgactgggtgccgggcgtgggcggaacgacgctgggtttcaacattccgacgatcccggcgctggccgccggcggcgttgcaaccgccccaacactggccatgatcggcgagggcggggagccggaggcggtcatgccgctgtccaagctggcggagctgctggacgagtggaccaaaccgaaaccgcagggcggcggaggaggccaggaggacgccggcggggatcacatcgtatggtcccccgtgttcaacttctacgggaacacgaccaaggaggaagctgtggccgccgcaagaatgagttttgcggagttcaagaaaatgtataagcagatgaaagccgaggaacggcgcaagagtttttccccggcataaggagggccacgcatggcaggaacctataccacccaacagggggacgcctgggacgctatcgcgcacaaggtatatggaagtgaaaaatataccggctggcttatgcagaacaattttcccctgctggacattttcgtgtttggggcgggaacggtcctgcaaacgccggacccgccggaggatgacgaaacggccaatctgccgatctggaggacgcaggcatgaaaacacgcagcgcggaggtggatctaacctggaacggcgcggcagtcaaaagcaaaatgctgggccaaacaacagagatcacatacacggatccagcaagcggagaagcggacagcctggatatttcgatccacgacagggaccgccaatggacggtggcgtggctgccgctggagggcgacacgctggaggccgccatcaaaatttccaactgggaccgggagggcgacaaccgcaccctcccctgcgggtttttcatcctggacaatttcgagtttgcggggtggccgatcaccgggaccatatccgccgtgtctgtaccggcggacggtgcatttcgggaaaccgaacggacaaagacatgggagaaagtcacggtccaggagatcgggaaagagattgcaagccgggccggaattactctggcctgggatgtggaggggacgccattcacgatccaatccattgagcagtcaagccagacagattgtgacttttacatgcaggtgtgcgagagctacggctacgccatgaaagtgtatgctcaaaaatcgtggtatttgaccgcgaggcatacaagaaaaaggacccggtgctgacaatccgggagagcgacattgaaagctggagctggaaaaagaccctggccgggacctacaccggcggggaatacacctacacggacccgatcaccgaggaggagatcaaggccacggtgggaacgggcacaaggatcctgaaacaatccggaaaggccgacaacctggcagacgcagagagaaagatccaggcggcggtggacagcgcgaaccacggacacaccaccatttccatgaccatcaccggaaatgccacgctggtggccacccaatgcgtcacggtggtgggcctggggcgcctgtctggaaagtattacatcgacagtatcacccaccatgtcgggaacggctacaccatggacctggagctgtcactggtggaagccatgaccgaggaagtgatcaaggacgccaccgagaggctggctgccgtgggcgtcatggcctccccggaatattgggtggcccattacaaggatgtgaagaacctggacggcctgatcctgaacatggccaccaggatcaaggtaaaccagggtgggacaagtatcacaacggtggacgcggcgctggatgtgctgacaaaaaccggcgtgatcaactcccccgactactgggcaaccgcttacacctccctggcgtggctggacaccctgctgatcagcgcggccaacgcactgacggcggattgagaggagggacacatggcaaacgatattttccgagtgggaaaggtttcgtccatcgactacgccgccggcctggtgcgggtggcatatcacgacaaagacgatagcgtaaccgcacccctgccaatgctttgcacggagtacaacatgccccaggtgggcgatccagtcatggtgctgcacctgtccaacggaaccgaggcggggctggtgctgggccggtattggtcaaacaacaacaagccccggagggtgcggcgggcctgttccgcaaggatctggaccggacgccggggaaagccatgatccggtacgacggaagcacactaaccatcaaatgtgccggagccatcaacatagaggcgggcggcgccgtaaccatcaacggggccaccattgacctgaattagaggaggaacagccatgccgcaggcggcaaggataaccgacgcggtggcagggaccaccgcgggggaacacacggggcatgtgccgccacattccccggagcagttcagcggggagatctccggggcatgctccgggaccgtgcggatcaacgggctggctgccgctacggtgggaagcattaccaccgagcgggacgggtgctgtggatccagcgagggcaccgtgggagctgggagcgggaccgtacggatcaacgggaaagcggcggcccgcatgggcgacgccctggcggcacatagcgggagcgggaccgtgacgggcggcagctctaatgttcggatagggggataaactgtgaccattggaacactggggagccgtatcgtgttcgaggtgagcgacgaaacggccctgatcctccaggaaatgaccagggagatctccgggcgctgggcaatccatgaaaccatgggagcaaagccgaaagcggagtttttggggcctggcctccaaagtgtaaccctgcccatttacctgtccgccggcctgggggtacgccccaggaccgtgctggagcgggtggagggcatggtggaggcagggacggcggaatatctggtgatcggaaacaggccggtgggcgggaacccgttccgcctgaccggatccagcgaaacatggaacaccatatttaaccgcggggagctggcgaaagccacactgtccatcaccctggaggagtacgcatgaatatttcaccatacgattttcaactacaattcactttcgcctccgacaagctggcggagctggaccgaaaactggccctgctgtattccaccagggagggaaccatgccgctggatcgggagtttgggatcaacatggattttgtggacatgccgccggaggtagcaaaaagcctgtatgtggcggagatcacaaaaaagacggcccaatttatcccggaggtgcgggtgcaatccgtggagtggacccacggaggcgagggacaattttttcccaaggtggtgatcacaagtgcctgatatgtcggcaatcgaaaacacgccagagatcagtttcattgacaataagactgtggaagatgtacgcagcgaaatggtggcggactatgaggaatacatgacaaacgcccagggcgtggctgtttccctggaccgggccagcgtccaccgtatgatcctatacgccgcagcggcgcagatttaccaggccatgcagtacatagaccgccagggcaaacaaagcctgctgaaatacagctattccgactttctggacaatctggcgatctttaagggcgtgaccagaaaccaggcaacggcggcaacatgcaccctgcgctttaccctttcggcggagcgggaaacggccacggcaatcccgcagggcaccagggtggcctcctccggggcggtgtactttgccacggatgaatatgcagagatcccggcgggcagcaccaccgtggatgtgccggccacctgcacggaaacaggaagcgcaggaaacgggctgaccgccggagagctgtccaccattgtggatcctgtcccctatgtggccagcgtaaccaacaccaccaccacggagggcggcgcggagattgagagcgacgcagacctggcggagcgggtctatctggcgcctggcgcctattctacggcaggaccggaggacggctatctgtaccactccaaagcgtacaaccccgccataggggatgtggtggccaccagcgaccaggaagcgggaaccgtggacattgttttcatcatggcggacggatccacaccggggccggaaatgatcaacggtctgaaaggctacctgaacgacaaaacgatccgccccatgacggatctggtcaatgtgtcggccccggaggaggtccaatacaccatcaacctgacatactacataaaccggagcgacagcgccaaggccgtgaccattcaagcggcggtggcccaggccgtggaagattataagacatggcagcggaccattgggcgagatataaacccgtccaagctggtggcgcttattatggaggcgggcgccaagcgggtgaccgtgacggccccaacatacaccgccgtggccgccaccaaagtgtccgccctccagggcgaggccgtgatcagttacgggggctggaagatgattaaactttccgggagccggtttaccgatattgcgccggagaacctggcaagccaggtagaagtccaggcgattgcctacgcggtagggcggcaggtggaaaaactgtgcgcatactctgacgcagcgcggacctatgcggccattgccaccatgccggagtggctactggattacatggcggtggagctgcgcaccccgtcctatgatgaaaactattccatcaaaaccaagcgggcgctgatcgaggggtccctgttgttttacacgcagatgggcacccccgcggcggtcaatcggatcattgaaaccatttttgaaaccgggtacatcgaggagtggtacgagtacgacggagagccgcatcatttccgagcctatgtcggggacggcggcgaggtggggccgggagagctggaggagttccggcgggtcctgtcctctgtcaagcgcctttcctcctggctggatgacattatcaccattgcggtcatggatcccgcggtcctgaccatcacgggggccatggggcggggctacatgtccaccgccctgccggcggcgcccatggactacaacctggaggcaccgatccgagcgggcggggttttcgggtccattatgcagaccgccatcccggcggcggattaaggaggaaaaaatgttttacggatttgtaatcacggaggccggcaacaacatgctggccaacatggtggccggcgataagctgaccatcaccaaggtggtcatggacaaggggaccgcggaaagcgcaaacgcggccaggcagcttaccgcccccattgacccaggcccgaacggaaccagcatcacgccgacggtggacggagccgccgtcaacatggtggtggaataccgcagcgacctgaacggagggctgcaagagggtttctggatcggcggtttctgcgtgtacgcaaagaccgaaaccgtggcggaaacaatggtctattacggatccctgggagatcaaaagcagtatgtgagcgcctatgtggaggggaccgccccggatgtgcgccgataccccgtttccatcaccgtgaccgccggcgtggaggttgatgtgtcctatccggcggaggcatggatgaccgccgaggatgtggcggagctgttcaacgacaccctaaagccgcagctggaggcaagtctggatgatctgatcgacgatcacaacgaggacccggaggcccacaacggcgccctgaaagacaagcaggacgccatcaaggtggagggcctgctgaaagggaccaaggccaccggagagggcggggacacatacagcgtaggggcggccacaccgggcaccgattaccagccgcccaccaacaccctgacgccggcggaggccatgaccacgcaggattacatcccgttctatgaccacaccagcggccagcacatgagggccaccctccagagtttgaaagaggccataggcgtacaaagccccagtattaaggtaaccacctgcgcgggtgccgccgttacctgttcggacggggaaaccaccctgcaagggacggggacaacggagtttgagctgccacacatcggggaatggaccgtaaccgcaacactggacggagagagcgccagccaggaggtggaggtaaccggcgccctgctgtatgaggtggacctgatgatcacaagcggggtggcggtgaccacgcagcccacaaagaccacctattacatcggagaagcgtttgaccccaccggaatggtggtaacggcgacatttgcggatgacacaaccgaaaatgtgaccaacgattgcacattctcccccaccagcatttccaaggacaccacggccatcaccgtgaactatcagagggcagggatccagaaaaccaccagcgtcccagtgactgtacgggtgctgtccagcattgagatcaccacgccgcccacaaaaacggcgtacaaatatggggaaatattcgaccccaccggaatggtggtaaccgcccactacaccgacgggcaaagccggacggtgaccgggtacgccttttccccaaacaccgccctgggcatgagcaacaccaccattacgatctcttacacggagggcgatgtaaccaaaacggacacgcagaccatcacggtggccaaggtgctggaccatatcgccgtaaccacgccgcccagccggaccagctatttctccggggagaatttcagcaccgccggcatggtggtgaccgcctattacaccgatgacagcagcgcggcggtgagcgggtacacctattcccccactggcgccctggcggcgggaaacaatacgatcaccatttcgtacagcgagggaggcgtgaccaagaccaccacccaggccatcaccgtgaccacgatcagctccaccctgaacagcaattcgtgggccaccatcaaggcggtttccgacgcaggccagggggacaactattgggatgtgggcgacacaaagaccatcaccatcaacgggaaagtggggaatttcactttttccaacctgtccattgccgtctttatcctgggtttcaaccacaacagcagccgggaggggagcaaccggatccacttccagatcgggaaaatctccaacaagctggtgggcctgtgtgatagccaatacggaagctatccgagcgggtccgggtacttcaacatgaacaccagccggaccaataccggaggctggaacagctccaacatgcggcggaatatcctgggcaacaccgggacaccctccagcccgccggcaaacacgctgctggcggccctgcctgcggatctccgagccgttatgaagtctgtgaccaagtacagcgacaacaccggcggcggatccaacacggccagctatgtgacggccaccaccgactggcttttcctgctggcggagtttgaataccacggaagccggagctacgcaaacagcgcggagcagaattaccaacagcagtatgcctattaccaggcgggcaacagcaaggtgcattacaggcacgacaacacgggaacggcggtctatgcgtggtgccggtccgtcgatgcgtcgaacagcaactatttctgccttgtcaatacggacggcacggccgccaccggcggcgccgacgattcatgggccgtggctcccggctttgccgcctaatccgccgcagcggatcccgcccctatcccgtccgcgaaagcgggcgggaaacggggccgcaaacactgtgagaggaggacaccaccgtgtccgttctgaaagataagaggaccacaagcaaagcggaatatgtgaatgtggccaaccagatttatgtgaaaaccgtggattttctttcgagggtgtccccgcgatattcccggctgattgcggcggacaccgcacacctggccgggcaggtcatggatcacgcggaggaagcaaacaagatctatccgtcggaccagctgcgcaaggatctgcggaaaagccaccacctggaggccatggcccacctttcggccctggatgtgcgcctgtcccattgctatcaaattttgtactgcaatccgcagggcgctttcacggacggaaagggccacaaggtgccggccaaggaggccatggagcgactggacaatatgagccaggacctgggggatctgattaaccaggaagccgatctcctaaagggagttatggagagcgataaaaagcggaaataggtcatacacgggtgtatttctgaacaagtgccgtgtggcagggcggcaggcggcggcggtcaatgcgtggtgccggtccgtcaatgcgtcgaacagcaacaatttctgccttgtcaatacggacggcacggccaacaacaacaacgccgacaattcaagggccgtggcccccggattttatagaatgggttgaaagcggacgcggtgcgcgtcccgaacccgtataaaaggaggaatacttccctggcagtcatgcctaaaactgcccactgacggccaaacacggacgctgcttgcatggcggggtattgcgctatccccgtttcatgtgtcgggccaaagtagtttatacgcgcacctacaagacaactatgcggagggcgaatactttttattatgaccagcgaggagcgccgggaggcgcgttacaaacgccgccaggaacgacggcggcggaacaggcaaacccgcagcgacaggctgggcggcctggagggcgttttcagttaccacaccatgtttaagcatgggaaaaagtgctgcaatggggtgcgctggaaagcgtccacacagaactttgaactgcacttgttttccggcacggcgaaacgccggcgcgaggtgctaaccggcaaatggaagccgggaaaaaccgtatcattcccgctgtgtgagcggggaaagtttcggatcatcgacgcgccgcacatcacggaccggcagatccacaaggtgctgaccaaggaggtactggcgccgctctactgccccggcatgatctacgacaacggcgccagccaaaagggcaagggcctgcattttcattacaagaggctaaaggaacacctgcgctggcattgccggaggtacgggagaacaggggccatgttcctgatggattttcaccactttttcccggaggcgccccatgcgctgatatacgaacgacaccgggagctgatcctggatccaaacctgcgggcgctggcggatctggtggtggcagcggtgccgggcggtgtgggtatgccgctgggcgtggagccgagccagcaggaaatggtggcgcttccctctttcctggacaactggatgaaatgccagctttcgatccacggaatgagccactacatggacgattacgacgcggtgctggagagccgggagcgggcggagcgggtgaaagcggaagcgatccgccgggccgaggccaaggggctgcaagtgaaccggaacaaatgccatgtgattgacctggacaagccctttcgtttttgtaaagccaagtttcagattttgcccagcgggaggatcatcacacacgggtgccgggacggcatgaagcgggcgcggcgcaagctgcggtatttccgccagcaggtggacactggggaaaagatcgtggagcaggtggcggaatggctgaaaggcccaatcgcctactatgagcaattcaacgaccatgggcgggtgctgaaactgcgccgcctgtattatgccctgttcatcaagggcaggaaaaccgaggaggtaaaaccatgtatcggatcgtaaaagacggggcggccctggcgctgatcgaggcccccacctatgtacggcaggcaggaaacgggtgttttgtgctgtgccaggaggaccaggcgacggggattgcctacggcgggaccgtgtaccacctgctgggccgggaggccgtggagggagccgagagcgtgatcctggaggaaacggacgctggggaggagatcgagcggacggccaccacaaacgggatcgtattcaccaccatggcggaggccggatccatcgacaatgtgacagcggcagaacacgcggacctgttttccccgtgggcttacccagtcaactatacggcgggacagatccggcgctacacggacgggaaactatacaaatgcctccaggcgcacacaagtcaagctgactggacaccggacacggcggtgagcctgtgggtgagcatttcggatccggcagaggaatggccggagtggtcacagccgttgggggcacacgatgcctacgaccagggcgcaaaagtgagccacaacgggaaacattggatcagtaatgtggcggcaaatgtatgggagcctggtgtgtacgggtggacagaggcagaggaaaccgaaacagaaacggaggcgtaacccatggggaaagcctatattgtcaagcggcgggcgaggatcgacaccatcaccgggccggtcaatctaccctatggcaccgaggtggaggccgtggaggatcgcctgacctatcaagggcgccagctgtgcgcagtaacgagccgaaaggcgcacctgtattttgccaggaatgatgacgggcagggccaggagcggggcgccctgacgctggccatcacaaaacggctggagaagcgggacaaggaccatcaacggcgctgggatctggtatgggaggatcccgtgtgccagaaataccggcacccggagcatgaggatcattttctgtggggccacgcatttttcgaggccccggtggatgacctgcggcacattgccgcgctgatcggcgcaagggggtgaccgccatggataacacacggctggtgacggagctgtgcgccatcattgacagaatgaatgtgattttacaggcccaagccatggagctggcgcagctccacgcgctccaccacgaggaggagatcgcggcagtccgccgggactatgcgcgggccattggggaggtggccccatgacggcggcggaggtgctgaccggcggcgggatcatcctggtggccatgacgctgatccagattgcccccattaagctggatccgtggtccgctgttgcgcgggccatcgggcgggccatcaacaaggatgtgatcgaaaagctggatgaaacccgcgagatcctggacgcccacataaaaatggacggagccaggacggcggacgcgcaccgggccaggatcctgcaatttaacaatgaactgttgcgggacattccacacacgcgggaggaatttattgaaattcttgcggagatcgaccaatacgaaaaatattgcaaggaaaacccggactaccagaacaaccggaccacccatgccgtggccaatatcagccgggtatatgatgaccggctgatcaagcacgattttctaaaggaggaaacgccgtgaaaagcctgattgtggcagctgccgccatggccctgggcaccgccctggggtttctgatctgcggcgccaccgtccggcacctgcgccaaagggtgcggaccctgcggaggcagacaaagaccggaccgcccaaaaagatgggcgtcatggacaaggtgctgatttttgaggccgtgatcctgattgcctacaccgtggcggatctggcggtgttctggcatacaggggccgagccgtacaccctgacgggctgcgtgttcggcgtgtgcggccttgaaaacggcgtaatgggatggatcaagaccaacaaggacaaggcggcggaggccgccagaacgagcgggaacggccaaaaggccgaccaggaagaaccacccacggagcgggcggaaccgtccgatgtggggatttaaggagggtttaccaatgacagagaaccaactgcggcagaatgtggccaacattatcaacgcatgggtgggcgcaacaaagggaagcgccaagcacctggagatcctggagatctacaacgggcacgagccgctggcccgcggctacaaaatgcaggtgaaagacgcctattgtgcggcaaccgtcagcgcggcgtatatcaaggcggggattgcggagtacaccgggacagagtgcggcgtggaaaagttcaccgtggtggccaagaacaagggaatttgggttgagaacgacgcacacacgccaaagatcggggacgcctgcgtgtacgattgggacgatagcggaaccggcgacaacaccggatccggggaccacatcgggattgtcacccaggcgggagcctccactttcgtggtgacagaggggaacatgtccggcggaaaagtgggaaagcgcaccatggcggtgaatggaaaatacatccgcggctttatctgcccggactttgccgccattgcaaagaaaatgggcggcggatcctccgacacaacgggaggcgccacgatctacacggtgaagtccggggacaccctttccaagatcgccaatacatacggcacgacggtggacaccctggcggagatcaacgccatcaaaaacaaaaacctgatccgggtgggacaggtgatcatgctccaggacacggcccaggcagctgccgacaagctggaggcgctgggcgtgatcaattccccggactactgggcagacgcggcggaggccgggaaagtccaatacctggggatcctgctgaaaaaggcggcgcagactatcacaaaggccgggacgcgcaccaatacgccggaggagggcgtggccgccctggtggccgccggcgtgatcaatacgccggagttctggctggccaattacaacacattcccctccctggacctgctgctgtgcgccctgggcggggctgtgaaataatcagaggaggacatacacatggaaaccattatgcagtacattcccctggcggtgtccgccatcctgctggcggccctgatcctgaccgtgatcaccaacatcatcacccaggtggtcaagaaaatcacatgggataagatcccaacaaatatcctggcggtggtggtggccatggccgtcacgctggtggcgttctttgcggcctgccagatcatgggctgggctgtcacctggtacatggtggccggcgcggtggccctgggcctgttcgtcagctatgcggccatgttcggatttgataagctccgggaggccctggagcagatcaccaactggggaaaagacaagacggaataaagaggacccccggcacctacatggtgccgggggctatattatagattaaattacactatcatcagcggagacaatgcaaatacctccatttccaacatggaacacattgccaccgtcatcagagtaggatttcacgccgctgtgtcgcttacttccatcatacatgtttgtttcgtattcccattcagggtgacgggtcagttttccgaccacttcaaagccaaccgatttggcgtattctctaattttcataaaaggcccctttccgccagagggcgcctgatccaccggatcaggcgattgcctccagctccatatcttcaatttcggcccaagtaaatcccaggcggtgcatatcgtccccaacattggaaaggaccacgctggcctccatggtgagatccgcatagcaaagagcggcgaacatcttatagacctccacggcccgctccatggtgaaaacccggatattgccaaccatggcaccatatttcccgttctgcttaatcaacatgatctttaccacctttcaaaattctgcggaatagccgccggagcgggacgaacaccgccacaaagatcaccagagaaattataaatttcatcgtttgccctcctattgacaaagctggatgatttgttttatatttggggtgcggggttgaggccccgcacccctggcctttaccagtcaagcaatttgaggattgccgctgttatcaggccggagatcgtgcccgccagaatgtcggccagcaagtcaacctttctggagggccgcgccgtaggctttcgcctgcggcgttttttcttgcccatatcaaccaccccctttctgattattattatatactcgcgtgagtatcaaaacaagatggaatgttgtacaaatatactcacgcgagtttgtgaaagttatatacttgcgtgagataacaaacggtggtaaaatgccatcaaggaggcgatcgcatggaacagagaaaaggaacagccgcaacgagggcgaaaaacaaatataacgccgaaaattatgatcggctttatccctatgtaaagcgggggaagaaagagaaataccaaagagcggcggaggccgccgggtgtagcctgaacgagtttatggaaaaggcaatggataaactggcggacgaaatcctgggggaataataccgccggggcaatcacatggataattcccctctgtggggcctatattttattctgctgattattaccacgggtttgacgccgatcccgtggtaatatcaagaaaaatgtgggccataaccacaacggaggggcgccggtgaagttttacgagatcaacggaaaaaggaatttgtgcggggacaggatccgggaggccaggcagaaacggaggctttcccagtcagacctatgcaagctgctgcaactgcgggggatcatggtggagcgggatgtgatcagccgcatggagagcgggagcagaattgtgacggactttgaagctgtggccattgcggaggtcctggaggtccccgtgctgtggctgctgggcaaagaataggccggcgtggtagagagaaccacgccggcctattgccatattacagagaaagagaggccgccccatgaaaggatataaacacctgacagagcatgaccggaacaaaattgcaaagatgaaaaaagagggggccaccctgcgggagataggggcggccctccatgtgagcgcggccaccgtatgccgggagataaagcgcgggacatatacatacatgaacgcggattacatcgaggtaaccgagtacatcccggagcggtcacaccagagataccgggccaatatggaagcgaaagggccgggcctgaaaatcggaaatcacagggattatgcggagaaattggaggagctgatcgtggatcaagattttagcccctccgccgccctgcatgaaattgaaaaccacccggagatttacggggattttgggatccgggtatgccgtcaaactctgtattcctatgtggacaagaggatctttgcgcgactgaccaacaaggatctgccctttaaggggtccaggagaaagacgaaaaccaagcacatccaccgcatgaaatccgcctccaagggggacagcatagagaaaaggccggaggaagtcaacacacgccaggagccgggacactgggagatggatctggtggtgtcctgccgcggcggccacaagtgcctcctggtgctgaccgagcgggtaacgcgccaggagattatgcggctgatcccggacaagaccgccggcagcgtggtgcgggccttgaacacaatagagcggaaatatgggaaactgttcccggctgtttttaagtcaatcaccgtggacaatgggtcagagttcgcggactgcgccggcctggagcaatccgtattaaaaaagcgggcgaagcgcacgaaaatgtactactgtcacccatattgtagcagcgaaagaggaagcaacgaaaagcaaaaccagatgatccggcggaagtttccaaaggggacaaactttgataaagtttccccaaaggaggtaaaaatggtggaggactggctgaacagatacccccgcaagatcctgggatggtacagcagcgcggacatgttccgggcactgatcgaggccgtttgaaaatttttttactttttgttacgcttacctattgacatttgcgcaacagcatgatcgggcattgtaaatgaacctccactcagcgcaacatcttcagaataccagccgctgaagcggtaatctgtgacatccggcatctttgccagttccacagtctcaccgtacttgcaggtctgttcacccggcacttccggcgcacccgcagggactgtaccttcatactcatacgtcactgtgtactcgttccggtcgtagtacagcttcagcaccagcgtgccgtcctcggcgatgataccggaggaattcgaacggctttcattataagtgaagccttcgtattccttgatttcagcagtggcagtatctccgacagtaccagagggtgtcaatgtatcagctgcaacgatcgagtagttatcatctttcaaattctgctgatagtactctacccgatagctggccgtggaggacttccactgggcgtacagggtcacatcggtgtttttgatagtgatggcactccccgccgcataaggcgttccggcgccgttcttctcggtgttccacccggtaaactcataccccggccgggtgaacatgttttggagcaccatggcctcgccgccggtgatgtagtacttggggtccgtgaccgtaccgtcggcatcatcggcgttggcaacatacaacacctgatacgtctccaccggcgcttcgggggactccgtcagctccagagactgattcggcttctcatccaccatgtagccgctcagaccggccttgtgttcgcccgtgtcatttgtcacataggtatcggcgtcgctccagctgccgtttacatcgggctggatggggaacgtcaggaccagcttgccgccggaccaagtgacgttgccgttctcagtagtcttcgtcaccgcatggtctgtatagtcaaagccctccacagtgatggtcttgctgtcggcatttaccacaggggtaacgccatcaagcgtctgcagagaatcccaggtatatttgccgtattggtcctgcccagtgaccttcgcatactggaccgtcaccgcatcggaactgcctgtcagcccctccgggaaggtgaagaagtccgacagcgtgtcggacagcaccgtgttcgcgccggccgccaccttggaggtgctcacgttatcggcgatggtgctgaaagcgttttccagctcctcggcatcgtccgccgcgaagtagtagttgccttccgtcacgcgggtgccaagattgcaaaaattccagcttgcttgtccgaaccgatttgttgccgtggcattgggatagttggaagacacaccgttcatgtacttgttgaagttgtcccgtatatcatcgggatccgcatcctcaaacataccgatggtgtacacggtcacgccgttgtttttcaaatcgtgggccagattgacagcggttgctgcgacatcgtcatcaaagtcgttgccgtggttgggctcaccatcggtaaagaccaccacgacctgcttggcgtcctgccgggcgccggtcagcgtcggatcctcgacccaccactcgccgccgtcgtgtctccactgtccgtccaggacgtcctgcgcaagggtcaggccgtagtctacgctggtggcgccggcgggctccagcgcttcgattgcgccggtcagctgctgaacgcccgccgcatcgacggtggtaaagtccttgacgatctgtgtatagttgtaggcataatagtcgtcttggcggtcgtttccgacgctgtccgcgtaggagtcatccgcaaacttgacaatgctgattcggtgggtcacgtcattgtctgcacccgccgcgttttcggccacttgatcaatgaagccgtttacagcgctctgcatggcctccatcttggaagtcgttatctcttggcgcgtgtaaagagtacctgtccaaaggttggcattctggttcctgctggtagtaccgagctgattccagtcccggtaaaccccgctgccggtataatacccgatggaatattgccggttcccccaagaaccatcactttcagcttccacttcgtagtagttgccgtcatcatcgcggaaataatacgtcgtccaccgagacccgttgatgtcgctatacgaccatctctgttcatcagtgggggtatattcccacgtgctctctcccaggtcatcatccatcgacccggagacatccagcaccagcacaatatccagcggtgtggtcttgcttcccttggtcacctcgttggtgacataggcctccagggtcagggaataatttccgtcctcatcatagttgaccgtcttgtccaccacgacgccgtcgttgctctctgtgtggacccggtcgctcccgttgccgccgccagggtcttctgccgccaaggcagcagtgggaaccattgtcagcatcatacagaggaccagaaatgctgacaagatccgtttcttcatcacttctcctccttttatatttcagtgatcttatatgtaaacatccttatggatggaatgaccggttccctccgcccacccggcggccagctgctccgtgtccagcatccgctcgtaggactgctccgccaacaggcgcacgccgcgctccacctccgcccgggtagccagatacagcttccgcaggcaccggggcgttcccttttcctcctctacccgggcgtcatgacacagggtctggatctcctccgtcacctgggtccggctcatgcctttcccgttccgggtgcagaacaccggccccgccgtcaggccctgccgccgggcgtagtccagcagctccccctgcagacaggcgggcaacgggacgtatcgccgctccctgccggtacggaccggcaggcgcccggcccgcacccgctcaacggtcacctgaggcagctcccccacccggatgcccgccagggcgaatattttcaccagcaggtaggtccgctccttttccagtatcctggcagcctgcagcagccgcagatactccacccggctcagttccggctggaggcccttgtccgcctccagctgccccaccaactgcaggtcccgccgccccatgtactccatcagcccgttggcggcagacaggtgggtattcacggtgctgggggaataccctgcctccagcaggaatgctcgccaagcagccagcgttccccgggagatctgcttgtccgggggcaggtagtcatagagggcccgcagcttggcactgtacatctgcaccgtgcccttgcggcgtcccctgccggacaggtccgccagataagcccggatggtctccatgctgagctcggcgccgggccagtccggtgtgcggtgtgtctcccgcggcttcagagcctctggactcctcatctccccgcctcctgtcaacagaatcgccatttcctcctgtaagggaccgaaacagggcctgcagaccaggggcaaatgtgcgcaaaaaagcccgcgcagcctgcgcgggctcaaaaatggcgcaaagacagcagccggacaaaattcgacgcttttccggccattttatgctgcccaaatcggtaaaagctcttgcggctggcggtgctttgtgctagaatttggttactgttaaaatcaattatgtatgtctagttatttttttgcagccatccgcatcggaatggcgattctgtcctatttctaacagatcagccccagccgtgccagagtcccggcgtgctcggtgcccgtggagatcaggtaaatccgggtcgtctcaatactggagtggcccagaacgtccgccagcctggccacgtcccggcagacacggtagaacgtcttggcgaacaggtgccgcagattgtggggaaacaccttgctaggtgccacgcccgccttgtcgcacagcgctttcatctccgcccagatctgccggcgggagatgcctttttcgtttctagtgagaaaaatctcgccggaagcgattttttgtttcctggcgtatttgaggagcttgcggcagagcttgcccggcagcaggatggtccggatcttgcccttcaaggagatttcggcccttccccggtacacggcctccacggtgacatagcgcacctcggacacccggattccggtgccgcaaatggtttccagcagcagcgccagccgttcccggccctgggtgcgggcggtctccagcaggcggaggtactccggcctcgtcagctcccggctgtcgtcccggaacagccgccgctggatgcgcaggggcttcacccgaaacgccggccagcccagaaatacaaggaaccggttgaccgccgccagcttgacgttgatggtggccggcgccagcttcgcctccagcaaggcggccttccaggcccccgccgccgccttggacgccgcccggccgtccagccaggcggtaaaatccgccgcatcccgcaggtatttctcgatggtggcggggctcttttcctcccacaccaggcgctgcctgaacgcctggagctgttctcctgtgatggtatagtcttgcactgcatatcgcctcccgtacaattatcctctatattttaccttccggccggctgtctatgtatccaatggattttgcgcggcagaacactgctctgacaccgacggataggccccggccctctgcttgcattgcgggccgatttgacgtattctttaataaaaaaggcaggtgccaaaaaaagggagggatcgccttggtgcggaccgcaaagcggacgcctctgattcacgccggacgggcttttgtactggccctggcggccggactggtgcttgttggctgcatggagtggagccgccggaaccaggagcgggaccgcatgggctatgtcgccagcgccatcggggcggagacgtatgagtttatgctctccgagatgagcaaaacccgcgttctggaggcctatctcatccagaccagcggggactattcggacttcggcagggtcgcccatgtcctgctgcgggaggactatgtgcgaaacgtcctcttcgcgccggacgggatcgtggacggtgtctttcccctggagggaaacgaggatgtcgtcgggctgaacatgtacggggacggggccggcaatctggaggctcaagctgccatcgaaaaagaggcgctgtatatcgccggccccttccagctgatccagggcggcctgggcatcgccgggcggctgccggtctttctgacggacgaacagggccagcggtatttctggggcattgtctccgtgacgctggactttccggccgccctgtccggaagctccgtggagcgggtaaatgcccagggcttcgcctgccaaatttggcgcatcaatccggacgacggacagaaacaggtgattctcgagacggcggacccgctgccggagggtgtgcggactgtggaccacgcgcaggagctgttcaactctgtctggaccgtctccctggcgcccctgcggccctggtatctccagatcagcctgtggctgggggtggcggtgagcctgctggtggcgttgctggctgcggcgggcgtctactacgcgggccggctgcggcagctgcagctggaaaaatcccagcgggccatccagcagctgcaggagcagctggagcgggaacagggcaatatgctgctgaaccagatccgctcccacttcttttaccacaccctcaacgctctgcaggccctgatcgtcctgaagccggaggcggcctacaaaatggccggagacttcgcccgctacctgcggttcacactggactccgtcactgccgacggcgggatcggctccttccgggaggagatccgggcggtccgggcctatgcggatatcaaccagcagcagctgggggaccggctgcacatggtctacgagattcccgacgtggactttcccatccccctgctgaccatccaacccattgtggagaatgccatcctccacggcatcaagcccaaggtgggcggcggaaccgtctctttgaagctggaagagctgccggaccactggcaggtcacggtgacggacgacggcgtgggcttcggcctggaagctgtccgagagaagggctccatcgggctggagaatgtgcggcggcgcatagcccgcttccccggcagcgagctgcggatcaccagcacagtgggcatgggcacacaggctgtcctgacttatggaaagcgggggaaaaacatggaaaatctttcaaaatcgacctgaaagcgtacggtttccgtacgctccatctggtacaatagaaacatgagacaggggtgaccgcgattgaaaaccattctggtggacgacatgctgctggatctgcagctcttcgagttgaaatgtgcggacatgcctgattttgaaattgtggggaaattcaccgatcccaacgcggccattgagtacgccgccggccatgtggtggattttgccctgctggacatcgacatgccggggatggacggcatccatctggcccaggccctgcggcggctgcggagcgacatcatcatcgtcttcgccacggcccacccgaagtttgcggtggaggcgctgaagatgaaggcggactacatcatcttcaagccctttgaccgggaggacatcgccgatgtgatggagcgggccaagctgctgcgccgccgccagtgcaagcgcatccatttccacaccttcggggccttcgacatgctggtggacggcgagccggtgcacttccgctccggcaaggccaaggagctgatggccctgtgcgtgtatcgggacgggcggccggtgtccattcacgagatcgtggaaaacctatggggagagaacgccgacggcaccggctaccgccgcaccatcaaggagctggcagacaccctgcgggactatggcgcggaggagatgttcctgcgcagccgggggagcctgcgggtgcggatggacctggcggactcggattttcaggcattcatgagcggcgatgaggacgccatctgccagtttcagggggtgttcatgcagcagtattcctgggcggagcccatggtctgcacgctgcaggagaaaaaggagctgatgcttgcccgcatggggaagcaccgcatgtaaggagggggctgaaactttggatgagttactgagaatggagcacgtcagcaaacgcttcggcgatttctacgccaacagggacatcaacctgtccgtccgcaagggcgaggtacataccctgttaggggagaacggcgcgggaaagagcacgctgatgaacgtcctcatcgggctgtaccagcccacagagggaaagatcttcctgaatgggaaggaggtccgcatcgactctcccgcccaggcggtgaagctgggcatcggtatggtgcatcagcacttcatgctggtggaggccatgacggtgttcgagaacatcatcctgggggaccggaacaccaagggcattttcatcgacaaggaggcccggaagaaggaaatcctggatctggcggagcgctatggtctggacgtggagctggaccggcccatcacggagattgccgtgggcgcccagcagcgggtggaaatcctgaaaaccctgtatcggggcgcggagctgctgattctggacgagcccaccgccgccctgacagacatcgaggtagagggactgttccagatcatccataagctgacggaggagggcaaaagcgtcatcttcatcagccacaagatgcgggaggtgctgcagatctccgaccgtatcaccattctgcgcaccggcgaggtcatcaccaccctggatcgctccgagaccgacggccaggagctggccaacctgatgatcggccgggagctggccccctcccactacggcaaggtggaggagccgggcgatcccgtcatccagatgcggagcgtggactaccacaaagaatccaagcacgcagggctcagcggcgtctccctgaccgtgggccggggcgagatcgtgggcattgccggcgtggacggcaacggccagagccagctggcccaggtggtcaccggcgtgctgacgccggacggcggtgaggtggacatgaagggctccaaggtggctcagttcacccccaacggctttattctggaaaatgtatcccacatcccggaggaccggaacaagatgggcctcatcggcaatatgtccgtgaaggacaatatcgtgctcaaggccacggactctccggagttctccagtgccaagggctactttctgaagaaaaaggccatccgggactacgccctgaagatgcaggagaagtacgacatccgctgcacctctgtggagcaggagacgcggaacctctccggcggcaaccagcagaaggtgatcctggcccgggagctggagggcagcccggacctgctggtggccgtccaccccacccggggcctggatatcggcgctacccgcttcgtccacgacaccatgatcgaggcccgggacaagggctgcggcgtattgctgatctccgcggacttcgacgaaatcctggaggtttccgaccgcattgtggtgatgttcgaggggcagatcatgggcgtgttctccggcaaaaatcctcccattgaggagatcagcctggccatggccgggaaataaggagggggagaacgcatgaaaaacagcggaaaactcgtcagtttcctggtacccatcatctccatcctgctggccttcgtcatcgggtgcatcatcatggccgtgctgggtgccaatccctttgtggcgctggagtccctttggatcggtgccttcggcagcctgcggaacgtaggcaccaccctggcccgctccacgccgctgatcttcaccagcctgtgcgcctgctttgcataccgctgcggcgtgttcaacctgggtggtgagggccagttcctgatgggctccatcgtctgctgctacattgccacccagagcgggatcgaaggactgcccgccattctcctgtgtctggtgggcggcgccgtggctggcggcctctggtccctgatttccggcctgctgaaggtctaccgtggccagaatgaaatgattatcaccatcatgctgaactatgtggccacgctgttcatgggcgtggtatataccgactggctgcgggacggcagcgttccgcagacgcaggccgtgccggaggccactcagctcagccgcctcttcggcctgcgggtcacctccgccttcgtcatcgccctggcggtgggactgctggtgtactatttcctgttctacacctccaagggcttccagctgcgggccgtgggcctgaacatgacggcggcggagttcaacggcttcgcggtgaagaagtacatcctgatgagctttatcgtctccggcgccatcgccggcctgggcggtagcgccgagctgctggggacccagttccggctcatcaacggcttcggcaacggctacggattcgacggcgtggccatggccctgatcggtcagctgcatcctctggcgaccattgtggtggccatcttcttcgcagctctgcgggtgggctctaccaccatgcaggcggccaccggcgtgcccaccagcgtatccgacatcatccaggccctggtgatcgtgttcaccgtggcgggtctggccatggtgaagctgcccggattcaaggcgttcctgggaaggctgacggagagacggaaggaggcggcctgatatggaatttgtcatgaacatcatcctctccagcgtccgcatggccacgcccctgatctttctggcgctggcggagctgtactcccagcgggcgggcctggtccacatcggactggagggcctggcctctatcggctctctggtgggctttctggtaagcctcatcaccggcagccccatgctgggcgtgctggctggcgcggcggtgggcattctggtgaacatgatcttcgcctacgctaccgtcaccctctgcgcggagcagatcgtctacggtatggccatcaacatcttcgccccggccctggcggccttcatctaccgggtctacttcggcgccgggtccgagctggtgcaggtgggtctgatgaacacgctgtcctcctccctgggcatcacctccgacaacttcctggtccgcctcctgctggaccagacgcccatggtgtacctggcttacggcctggtgatcttcacggttatctacttcaaccgtaccaagtccggcctgaactacaaggccgtgggcgagtatcccaaggcggcggcaactctgggcatcaacgtcattggcgtgaagtacgccgcctgcgtcatctgcggcgccctggccggcatcggcggtgcctatctcaccacctgctacgccaacacctacgtggacggcaacgtggcgggccggggcttcatcgccctggcggcggtgatcttcggccggtggagcggtgccggcgtgctgctggcgtgcctgttcttcggcttctgcgacgcgctgcagatccggctgcaggtgggcagcttcggcgtgccctatcagttcttccagatgatcccctacatcgccaccgtggtggtattggccggcatcggcatgaagaaggccggccccaagagctccggcaagccctatctcaaggaggagcgctgaggataatcgccgcccacgcggctgttatcaatagaaggcatccacatttatgaagaattgggaggaaagaacatgaaaaaattattggctctgcttctcaccctggtcatgtgcctgtcgctggcggcgtgcggcggctccggtaccgacacctccggcactgacacgtccagcggagaaaccggcgaagactccggcgacagcagctaccgggtggccatgatctgcgactccagcatctccgacggcgggtggggcatgtcctgctacaacgccatggtggatgccgccgcagagcgcggctgggccacggaggtctccgacagcatcgcccagtctgcctactatgacaccatcatctcctattgtgacctgggctatgacctgatctacgcccctggcaaccagtacaccgacgccgtccttcaggcggcggaggagttccccgatgtggccttcgccctgctgaacggcggcgaggacactcccgccaaagccgtcaacggcaatgtgacctccctgctgcccaatgcccagcaggtgggctggatcgccggtgccctggccggtcttatgaccaagagcggcacggtggccttcattggcgccatggaactggataccaccctgggcaagtataacggattcaaggaagccgccgcctatgtgggacagcaggagggcaaaaccgtctccactctggatgtggtctactccggcgacttttccgccgccgacaagggcattgagtttgccaaggccatgatcgaccagggcgctgatgtgttctttggcgacgcctccgctgtggactccggcgcacggcaggccattgacgaagccaatgccgccagcggctccgtgagcatctatgacatcgcccagccctccgatctgttgggccagaacgagtgcatcatcggcagccaggtgacggacaatgcctcccttgtgggcctgtgcatggaggctgtggaggatggctccttcggcggcgaggtcatctacggcaccctgcagaacggtgccttgtccgcgggtgccctcagcgacctggtgcccgccgatgttcaggagaagtatcagggctacctggaccagatggtggacggcagctttatgcagtaagatttatacccgcaaaccactgcggctccatccagatgcctggatggagccgctttcccccctgcccgggaaacttctgcccaacggtagaacggggcctgcagtgccgggcattggatggcgggcagccgctcccctcctccctggcccgcagacgcaaaacggccgtgcgatcaaaaatcgcacggccgtttttccgatattctgccccacaggaacggcgcggtccgccctgttcttcgggtcatcaggagcgggaagctctctcctcccggcagtcttccggttttttcgtgtggtttttataggtattccatgtgggttcatattccgctgtggcctgattgccccacatggcccagccctcccggtccccgcgggcaaacagctcaagaaacggccctggagagcatcgctcgatcagggggatgaattcgtccggttttctggagtgctcccgcttctgtgcccgcagcaggttcacctgggacctggccgggggcagcgtcctgttcccgccgcccctgacaccaaagagcagaatttccgtcacattccggaagtagaaccccacaccccggccgtccggttctccgtccttgcgaaccttctcccagatgatattgcccttgtactcgaatccccaggccttcatgaccgcaaggccgtcgggaagcagggcattgggtacccacagatacagatggctcttctccgccgccacctgtgccaccggcagcgccatgatgtcttccagctccatggtctcgtagcgattcagccgcttgtgctcaggcgctaccttcccggtccgattctggaacctccagggagggtcggcatatatggtggcgtatttttgatcgccgcagaaacgcagcagattttcagatgtttcctggattgtgctcatcgatgtacccttcctcccaatctgtgatgcacggtttcctgatgcctactgccagaatggggcatccgccgttcctgcgggaatccaagcgataggtcaatttccccatccaggtggtgctggccccgtacttccgcagaatgggtttccactggcgggtctttccgtcatagtcgtaaatggttttgaagatgtcgttcagctcggcagagcgcgtaatgatgatccctgcactgacaaggtcgcagtcataatacgtccgcatggccagcaggtcccggtcgaacgtctgatctttgctgttccactccagatcgaaggcgatccggtttttcagaaagtcgatattatgtccgtcgatatacccgggtatgaccttttcctcaaacggctcctgggaaaagcgtccccgctgttcggcctgccgcggatagaacttgatgtggaggtcgccggaaatgcggatctcgcgccatccgcggggatacagcacatcatcaaactttttggggatcttggtctcgtttccgccggactcccgaagatcgtccgtagtgatgcgcagctgacgcaggcagtccacaatctcgctccactccgccggaaatgcctgtgtgataatctcaagcgcgtgattatagctgtaaaattcaaacttctctaaaaggtcgggcgcaatatactctctcaagtccaaggcggctgtcctcctgtgttttagatattataacatcttttcctcccgttttcaccaccattttttgaatgcgccataattttcagggggtgcctcttttttacgtttcaccaatccgggtcccgcagcccccgccgggcagcaaaaatttcggaaagaggacacatgttaacagagcgcagccagttgggtgctgtggcaggatggtacatttccccagagagttttcagaaggggtacgacccaggcattgacgactatatggtgaagcccggcgacttcagcgggctgctcatgcgggtgcgggcactgctgcgccgggccaatattgaggccagccggaagctgtccgtggacggacttcttctgtatgccgacgcgctgacggcctctcttgctggagcggagatccccgtgaccatccgggaattcaacatcctgtacgagctgctgtcctgccccaaccgcaccttcccgctacgggcacaggcggaagttctgtggcagcggcagacacactgaacccgccgtcccgtcacgtcccctgcgtcaattcgcaaaggccatagccggaagtcccgcctctccgctgccgcagcgcaagaggcacccggatggctccccggtgcagagtccgcacacttgattgaaaatggatgcgcgggcggcaaatattgtggtataatatccatactgagatcgctggtggccgccgggccgcggccgctcctttctccggccgcggcccccgccctgtcagggcttttacgggcaaacgtccagcttcccggcgcaccgcagtgtgcagggctggagatcacagcaggtacggcagcctccgccgccccccgtccggccctcccccgatatttttgaaaacggtgcaaacgatcaggaccgtgtcgactgccggagcctaccggagggcggccgcctgctcttgtccggcggcggcgcaacgcgccggagggagctccgccctggctgcctgcaccaccgccggaacggcgtgaagcacggatgtgccatccgggggcacggcgtctccgcagggggcggcatcgagggcgcactgtccaaggggcagtcatcagaaaagaggaatgcgtatgtggattctcttcgcggctggatccgcgcttttcgccggtgtgacggccattctggccaagtgcggcatccggaagaccgactccaccgtggccaccgccatccgcacccttgtggtgctggtttttgcgtggaccatggtgtttgtcgtgggctcccagggggagatccggaacatcggccccacaacgctcctctttctgttgctgtccggcctggctaccggagcctcctggctgtgctacttcaaggccctccagctgggtgacatcaacaaggtggtgcccatcgacaaatccagcaccgtgctcaccatcctgctggccttttttctgctgggggagcccatcggcctgcctcaggggatcggggtggtgctgatcggcacaggcaccttcctgatgctggagaaaaggtcccccgccgccggctgtgcaccccagtgcgggagctggatgctctacgccttcggctcggcggtgtttgccagtctcaccgcgatcctgggcaaagccggcattcagggcgtggagtccaacctgggcaccgccatccgcaccggtgtggtgttggtgatggcctggctcatggtgctggtgacaggcaaggccggtgcggtgcggcaggtgccccggcgggagttggcgttcatctgcctgtccggcgtggccaccggggcctcctggctgtgctattaccgggcgcttcagagcggccccgccagcgtggtggtgcccatcgacaagttgagcattttggtcacagtggccttttcccggctggtgtttcgggagaggctcacatctcgctccgccgcaggtcttgccctcattgtggccgggacgctggccatgctgttctgaccgccggagccatccccctccagcggggttctcttcgcgcccacccgatgccggacaggtgttcctttcggcgggccgccagctggcggccgggggaaaatttccactcttgtttttttctgtacagcgtgctatactggccgaggtttaaggaatgcggcgaaagggggagctccctggcgccacgctcacatagatgacaagaaccagattgcgagggagcctgtgttccaggctgagagggtcccagtaagggccgaccgcacccggcttcccaggcggaagcgggggcatcagcatctgcgtgaaggtctgaacgggtatgtgctgatgaggcgcgtgcccgttttgttttgcgcagaaaattaaactggagggattcccatgaaaaagaagatttccgcacttttgttgagcctggcgctgtgcgccggactcctggccggctgcggcaccggggagacggcggaggctccgtccgacaccgatgtacagcaggtggactctctgaaaatcgcattttctccctatgcggacgccgacctcatctccgagtccacggagccgctggaggagctgctgaaggcaaagctgctggaaaagggctacgacgtgggcgagatcgacatgaccgtgggcaccagctacaccgccgtgggcgaggccctcagcgcgggcagcgcggacctgggcttcatctccggcggcaactatgtgctcttctccgacgactgcgatgtgctgctgaccgccctgcgctatgccatcaacaaggactctgagaaccccgccgactggaacgacggcaccatcgaggagaacacagaggacatgagcacttactaccgctgtatcctgctggccggtcccagcgagaagggccaggagctgctctccaaggtcaacgccggggaggagctgacctgggacgacctgaacagcgccacctgggcggtgctgaatcccacctccgcctccgggtacatctatccctccctgtggctgcaggagcactacggtaaggggatcagcgatctggacaatgtggtggagtgcgactcccacaccacctccgtggcccggctggctgccggtcaggtggatgtgatggtgtcctacggccacatccgcatcaagaacgcccccatctgggaatccgatttcggcggcacagccccatggtggagcagaccggcgtgatcggtgtgacggacggcatctacaacgacatgatcgcgtacagcaagacctctgacaccatggcggacgaagccttccggcaggcagtgggcgagtccttcatcgagctggcccagaccgaggagggccaggagatcttcggcgtattcagccaggtgggctacgactggggtagcgactccgactatgacggagagcgggcggcccaggcgcttttgaaatctatggaagcgtgaccatcttcaggagggatttcatgctgcaggcgatccatatccgcaaacaatttcagcgttccggcgaggtgctgcgggatgtcagcttcaccctgggcgacggcgagtttctctcggtcatcggcccgtccggcgccgggaaaaccaccctgttccgcatcctgaatggaacggagctgtgcagcggcggtgaagtcctctatggcgggacgcactttgaagccgcccgaggccgggaaaagcgggcgctccagcaggggatcggcaccatctatcaggatttctgcctggtggagaacctgtccgccatccagaacgtgctgaacgcctgcctgccggacatgtccctggccgcctccctgctgggggcgttcggacgggagcggtccgaacaggccgccgcgatcctgcgagaggtcgggctggcggacaagctggaggagccggtgaaaaacctctccggcgggcagaagcagcgggtggccatcgcccgcgccctgatgcggaacccctccatcctgctggcggacgagccggtggcgtccctggaccccgtcaccgggcggcaaatcctgtgcctgctccgggacattcagcgccaacgcggtgtcagcatcctgatgaacagccacaatctggacctgtccctggagttctccacccatatcgtcggcatgaaccggggacgcgttgtctttgacggcgcccccggggatgtgacggaggccgtcctgcgggatatttacggcgaggcggcggccgtatgaaacaaagacgtatccgctgcctcgctgcggccgcttttgtgctgctgttcctgggagccgcctggttcaccggatgcgacctgtccctgatgtggagccggcgcgaccacctgacggacatcgccgcaaagatgtttccgccggactggggattcctcgggaaggtcctgcccctgctgtgggccacgatccagatgtccattaccgggacgtttctgggcgcggtgctgtccatcccggccgccatggcctgcgccgccgccctgccgggacccggcccggtcaagaaggcggtccgcttctgcatccaggtgctccgctccttcccggccctgatcctggccctgctggccacattctttctgggcatcggctcctttgccggaacggccgccatcacggtctacacctttgccatcatgacccgcctgacctatgaggacatcgagagcgcgccccagggtccctatctggccctgcgggctatgggcgccgcctcagcccaggcgttcttccgctccaccttaccggagatcctgccggcctatctcaccaacgccctctatctgctggagggcaatgtgcggcacagcgccatcctgggctatgtgggcgcaggcggaatcggcctgctgctcaatgaaaaggtctcctggcgggagtacgacaaggtggggacgatcctgctgctcctcttcgccgtggtctatctcatggagcatctcagcacatggctcacccgtctggtgcagcaggagcggaccctgggccggcaggggcgccggctgctggcgggcgcggcggccgcgctggtattgttctgcacggtcacgcttccgccgcccgacctgtcccgcacaagcatgcagatggtgaagacgctcttcaccggcctcctgcatccgaactgggagctgtttttccgcctggacagcagcggacttgcctatctcctgctggagaccgtcgccatcgcgctggtggggacctgcgtcggcgccgtcttttccgttcctctggcgtttctcggcagcagccgctttttcccggcccccgccgcctggctgttccggacactggtgaccgccatccggtccgttcccttcctgatctatggactgatcttcatccgcgtctgcggccccggctcctttaccggagtgctgaccctggcagtgtgcagcgtgggacttctctgcaagcgcttcacagaggccatcgacaccttggattttcgggcgtatcacgctctggaggccatggggacgccgaagctgtcctgcgtccgccacgcggctctgccgcagctggtgcctcagttcttctccgcctggctctatcggtttgacgtcaatatccgcgaggcctccgcccttggcctggccggtgcgggcggaatcggcgcgccgctgatcctggccctgaaccaatacgcctggcatgatgtcagcactctggcgctgggcatgatcgccttgtcctggctggtggatctggtctccgctttctgccgccgcagggacgcctgaggccgatgcccgccagcagccggatccggtgcagccccccgttccgccccggcgggaaggattccggcggagctgctgcaaagcaagacacggacagtctttggactgtccgtgccttgcgattccccggccgggggccgctcagagtgcttcgtattccgcgtcgctcaccggctcgcaccactcgttggagcaggcctcaccgggcatctcgacggcgatgtggctgaaccagctgtcccgcttggcgccgtgccagtgcttgacctccgccgggatgacgatgactctgccgggctccaggctgaccgcctctttgccctcctcctggtaccaaccctcgccggcggtgcagatcagcagctgcccgccgccctcggaggcgtggtggatatgccagttgttccggcacccgggctcgaaggtgacgttggccagaaacagcccgtcctccgggcgggtcaggggattgagataggaccggccggcaaagtaccgggcaaaagcgtcgttgggcgcgcccaggccaaacacgttctgttcctcaaatgcagccttgtccatgatcttcatgcaacatacctcccaatgctttcttatgaatgcggggcagaccgccgccccggtgtggatgttctgccgccagcgtgtctcctgccgctcacgggtgtgaatatccgccagcgcggcggcccgtatctccaccagtagccgcagccgcatatagccccccgtctcctctccggtgaagccgatgtcccgaagcgtcaggatcaggttcagccgctccgggtcgcggcctgcccgacctcaggacctccatggagatctgatcgcactcgctggcctcctggatcgtcatcgcccgcacctcagggcagaaagtggagacgtccccgcagggacgcctccattctaaatctggaacttcgccttgtccaatgcctataccggatggtctgatattccgccgacgtatttctcggcaaatcgcagcagggcagcagcggtggcagaaaggacctcggtcttcttccaggccagaaccgtgcccgactccagcggcggagagaggggtacgaaccgcagcccgtcataggcgcaatccagccggatcaccagatagatccccagcccctcccgggccagctgggtctggttgtaaggcaggttgccgctggccgccacctggatccggtctgcgtaagggccgaaccagcggatcatttcccggcgcatcagctcccgggtggtcaggatcagggggctgtccgccaggtccccgggcgtcaccgcctcccgccgggccaggggcgaatcctccggcaccaggacgccccaggattcccggacgggcagccggaggatctggtagcggctggtgtccaccggctccagcagaagtcccatgtccaggagtccctgctcgatccgctccttgatcccgtcggagtctccgctgtaaatctcatactggacccggggatgctggcggtgaaaggcagccaggagctttgccagatacgtcatgctccgcaggtcgccgcttccgatggagatccggcctgtgacctcctccgccggtcggagctcccgggccgtcttctccgccagctctacgatctcctgagcccggcggcgcagcagcatcccggcctccgtcagaacgatgtggtgctggctgcggcggaacagcttgactcccagctcctcctccagctgcatcagctggcgggacagggtgggctgcgtcagatggagcagcgccgccgcccgggtgatgttctcctcccgggccacagtcaaaaaatacttcagcgtccgaaattccaccgggccgcacctcctcttctcccctaccatatcatggccgcagtggggccgcaagtgtgatatgtgtgaaatgtatgtctcagcatagaaaacatgtattcgctatttctcatttcaggcggtataatagggtcatgtgaggcgcggcgtccggactccggctgccgcagagctgcaacaggaaaggatggtttcgacctatggaataccgtgtcaaccgccgcaccggggaccggatcagcgtcctgggcgtgggcaccagcggcctccccgccgccggggcgaaagagggtgccgccacgctggagatggccctggagcaggggatcaactacttcgacctggccactgccgactccgcctgcttccccatcttcggcgccgcccttgcgggtgtgcgcaggcaggtgctctaccaggtccacttcggcgccaattacgccgccggtaaaccttacagctggaccacggatctggagaccgtcaagcggtcggtagcgtggcagctggagcagctgcggacggactacatcgactacggcttcatccactgtatggacgagtccggcgactggcgccggtatgtggacaacggcgttcttcagtttctggaggcgctgaaagcccagggcgtcgtccgccacatcggcctctccacccatacgccggccctggcccgggaggtgctggacaccggcctggcggacatgatgatgttcagcatcaaccccagctacgactatcagcacggcgagtatgccaacggcagcgccacggagcggatggccctttaccgccggtgcgaggcggagggcgtgggcatctccgtgatgaaggcctttgccggcggacagctgctggatgctcgtacctctcccttcggtcaggccctgacggaatatcaatgcatccagtacgccctggacaagcccggcgtcctgacggtgctgcccggtgtccgagaccgggcggatctggaacgggtcctgggctttctgcgggctggggaggcggagcgggactactccgtcatcagctccctcacccccagagacgcggagggcgcctgcgtctactgcaaccactgccagccctgccccgccggcctggacgtgggcctcatcaacaagtattatgacttggcccgtgcgggggatgccttggcggcagagcactaccggagcctgtctctgggtgcggatgcctgcatcagctgcggccactgtgaccgccggtgccccttccatgtatcccagtcggcgcggatgcgggagatcgcatcctacttccggcaggcgtgagggccctggccgttccttgcacctttgccggctacatcaatgagtggctgactgctgacatccccaccgtcctccgctccgccaccgccctggtgcccctgaagatggagacgcccgtccccttcaccggcacctggacggatgcggaggcctgtctgaaggaattctactgagtgcccttcacgtatccatctcccaaaatcaccaagacggctgccaacccggcagccgtctttttttcgttgattcccgcctcccccggaggtgcgccggaatcagaactgtttcagttatctccgataggatagggcgggggtgcgcgctcccgttttcacgggtgtccccgcggccggagccgccggcggacggtcagtcgtcacgtgcctcgtccgccggcttctcccgcggggtctgctgttcctttttcagggattccagtcccagccggatcaattccacggtcgcctccgaacgggtctggaaccggcgctcaaagcggaaatcctcgatctgctgaaacagctcattgtccacggataccgtgtaacgcggtctgtctgttgccatccttatcacctctggccctattatacacgagtgaaccaccggtgtaaagagagccgcagcccccttgacttcggttcagtgaaccactataataactttaataggttcaccaattcacttaaccactatatggaaaggagctgcgtacatgaacagagatcaaaaacggtttaccatctccgtgacgccggagctggcggcggaactgaccgcggtaaagcagagcagctaccccggcgtcccccgggacgcgatgttccgggacctaatcatccggggccttgcggcgtgggagaagcagtccggcaagaatagccagcccgtgtgacgggtggggtgccgggccccatcgaagctccttcggctctcccggcaaacggcggcagacagaaacagacagaaacacggtgaaagtcagaggcggcaggtacgcccggtgcgggcacccgtgggcagctgcccgcacccgccatcccatggagacagcagaacaattctgggcgttcctgaccgggagcgtccaaagcggtgcagggttcagtccgtatgtcatacggtcgtaacccgccgttcatcgctccccctgaccgggaggagacggaacgtgagcaaagtaaccatgagacggccggatgcccgggccatggcccagcttctggcggagcagacgcagacggcggcggggctgatcctccgcctggcctggcggcaggggctgacccgggaggagatccagcgcctcacttggaacgatgtggacttttctgcccatcagctccggctgccggaccggaccatcccgctggagacggagaccgaggactgcctgcgccggcaggcggagcgccccgacccgcctactcccttcgtggtggtctcggaccgccgcaggcagcagatgccgccggagtccatttcccgcctggccagaaaaactctggaccgggcggggctgggcggcatcagcctgatggatctgcggcacgacttcatcatccgccatctggaatcccacgactggccctatgtggcccggatcagcggcatcgccgtccccactctgtatgccgttttctccgactatctgccggagggacggcagaaggactccctccctcggcaggaggtggacggttttttgatgtggaagctgctccaggcggagggcagctccccggtggggcttgccctttggatgggttggaagctggggatgcaggtccgggagatgacagccctgacctgggaccaggtggatctggaccggggtctggtgcggctgccggaccgggacctggccctgggcgtcaccctgcggcgcctgctgcgggcggcggcgggacgccggcggccgggtgaggacccgcacgtgctgctgacgcccaactcccggcggcccttggaccagccccggctgtccaagatggtgcggaccgccctgatccggggcgggatggagcacatcagcctgggagatctctgccgggaggagcgccgggagaacgaggacgcccggctgctggcctacgccgccgaaaaaggcaccatctcccggtcggaggccatgtcgctgctcggcctgtccaaggtggcggcctacgagcgtctccggcagctggctgagcggggaaagctggtgcgggtcggcggcaaatactaccccgccggccaggtggtgccgccggaggagcagtatgacgtcatccgtacatttctggagcagtccggtccggcctaccggcaggatctggcggcgctcctgcacgtcggcgacagacagtgtgccctgatcctcaagcacatggtggaggacgggcgcctggtgcaggccgggcagcggtacgcccttcccattcgtgaggaggttctgctgtgaacggcgcaaaaggagagcggccctcaggggccgctctcttttttggcccgcgccgcggccggagcagaaatcgcgtccgtgttatgatggcgtgacatggctgtccatgcgatttgtgcgccgtttttcaattggattaaaaggtttgcgaaacgctggacaccggcagttttttcccgtaaattggccttgcgaacggcggaagcgccccgcatccggctctgcggttggtgtaggccgacacaagttggttggctagcccccacacgaatcccagacccgcctggggtcttccggcggaccgcaaattttttgaaggaggagaaatcccaatgaagaagttcctttctctggtgcttgctctggtgatgaccatgtctctggtcaccgtcagcgccggcgccaaggacttcacggacgacagcgagatcacctacaaagaagctgtggatgtgatctctgccctgggtgttgtcgacggttattccgacggcgacttccgtcccgatgatgtcctgacccgtggcgcggccgccaagatcatctgcaacctgatcctgggccccaccaccgcctccgcgctcagcgcaggcaccgctccctttaaggatgttcccgtgaccaacaccttcgcgggctacatcacctactgctctcagcagggtatcatcagcggctatgctgacggcaccttccgtcccaccggcaccctgagcggcaacgcgttcatgaagatgctgctgggcgctctgggctatgacagctccatcgagggctacaccggcgccaactggcaggtcagcgtcatcaagcaggccagcggcatcggtctggacgacggcaacgacgagttcgtgggctcccaggctgtgacccgtcaggaggccgccctgtacgccttcaacatgctgcaggccaccatggtcgagtatgacaagaaggacaccatcgttgtgggcgacatcaccatcaacaccacttccacccgcaaggacgtggaaaacaataccaacaccgacggcaacatcgatggcgagcgcaacggcgacggcctgatgcagttcggcgagaagtatttcaaggacctggagaaggaggatgccaccgacatcttcggccatccctccagcaagtgggtctatgatggcgacgatgtgggcacctatgccaacgaggctgacgccacttatgtggtggaggacgacgatatggacgtcggccaggtggtcaccagctccagctacatgaattacagcagctccgaagccaaggatgccaagtacttcctgaacggcgatgacaatgaggtgaagtcctctgagctggttgccgtgggcgatatcgtcgaggcttacgagaatgacaacggcgatgtggagaccgttgtggtttcccgctacactgttgccaagatcgacaaggtcgataccgacgtcagcaccgctgagagccgcaacggcgcctccgaggtcctgaccctcaccgatctggacggcgacaacagcaacgactactacgacaagtacgacgatgccgagaagaccctgcggggctatgcctcctcctatgacgagggcactgttctggccgtggccttccgcgacggcaagttcggcgatgaagtcctggcttcttacgaggccgaggctgtcaccggcgaagtcaccgctttccgtgaggacgagaccgtcaccatggacggcaccaagtatgagtttgcccgcaacgagaacggcaccgctggtttcgtggacggcatcaccagcaacttcgacttcgacaaggagtacaccatctacctgaccgccgacggctatgtcatcggtgtggagggtgccgctggtgcggacctgaacgacgtgtactatgtgaccggcgtttactgcgaggagagccgttacaatgccaacaagtttacctggtacgcccaggccgtgtccctggcggatggttctgcctctgacatcgagctggatgaaactgatgcggacaatgcactgaaggctttcattaatgatgaaaagacagatgagtttactgttgtcaatggcctgtatacctttgatgatgacattgccactgcttgggacggggacagagactataccgtctatggcttcagtgatagtggtgagctgaacaccaatttgaaggatgctctggctatggacgacaccaagttctccaccaccatcgtcggcggcggtagcggcaagaccttctatgtggacgagaacactcagtacctcggcgtggatgattatgccgatgatatcgacaccgtctatgccatgggcggcatgaagggtacaccgagcaacggaagccgtgtgatcgtgattgctgaccaggatgagaaccgtgacgccctgtatgtgatcctgctcggctccgacgcttccgttggctccgccgacatcctgtacgccgccggcagcagcaccgacaaggtgggcaccgacaagtacgtccgcgagttctggtccatggaggacaacaccagcgaggacatcaccatcgatgaaaagctgagtgcccatggcttctatgaggtggacagcatcgacgaggacggcgtctacacgctgaaggactatgacaagaccgcttcttctatcgatgaggattccgacggcatcgtcgtagaggatctggcgctggacaacacggaccagatctatcgcaacgctctgagcggctccatcgataacgtcaagttcgacgatgtcagcatcgccaacgccaccatcatcgatggccgcagcaactccgaccggaacgactccgtgtatgaccgcgagatcaacagcatctcccgtctggaggccgctctggatgccgtgagagacgaggatctggagaccaagggcactgtggagatcgatctgtacgtgaaggacggcgagatcaccttcatctgcgtcaccgacgtgggcggcgttgccaaagatgacggtgagcaggaaagcggcgagctggacctgaccggtgtggagaatttcgtctgcaacagcaatatcgttactgttgacctggtcggcaccggaaagattcccgctaactatcctgttactgtgactctgatgaaggccaacagcaccgagggcgatgcggaagtcggctccaaggagcatgtaaacgagactgcctatgaggttaatgattggaacaacctgggacaaatcgcgatccaggaaagtggtaattactatgtaattatcaccatcgaaaatgaagacggcagagttgtggatgagttcacttccaacactgtccgcttcgtctacactgcccagccgtaaggcaaatagtttctttcaagtaacttgttgcgcaagaaagcccccgctcgtaagagcgggggctttccctgtttccatcacatccaggccagtagtgctgaacaacgtcggcatcgttcccccctgactggccggtgcctcgtggttgatgaaaaatccatcgtcctccagccccgcgtattggcccgcagctttcaaaaaggtctctccaggagttgaaggagatcctgtctgctcagataacttttccctcttccccatgggtgccggtcttccggcgctcatttttttgtaaaatacagccagattcaagacaaaagtaaaaaaatatattatgatagattgaaaggggggttccaaattctggaagacaggctgcgcagcttccccacgcaatggaagatgtcgaattttctgagagatgtcgttttttcaggctttgctgtttttcgtcgtacaatcttctcatcgcaaatttcgaggaggtgctctccatggacacgatcatccgggaaacgctgcgcccctttggcattacgcgcaattaccgcggttacccgcagacggtccgcgccattgctctggtcctggaagacgaatcccgcctgctcaatgtcaccgaagagatctatgaagtcgtggccctgcagacccggtgccatccctccaacgtggagcggaacatccggactgtcgttctctgcgcgtggcatacaaaccgaccgcttctggtcaaaatggcgggatttacgctgacggctccgccccgcgcctcccagtttattgatatcattgcctcctacatccagcgggaagttttgagtgaccccaaccgccgtgtgctgatctgatgcccctcgcctgtctgttccgggatttggtaccgacggcccatctgcggcccccgtgcggcagggattcccgcatctgctgataaggtgggattcccgctctttactggcggcctgccggagcagccgccaaatcgcccgctcccctctccccggccaacgaatccggcacaggcggccgccctattccgcggggcggccgcctgtcagtctctcactctatttctggccggtgatcagcgccagccgggtctccacggtgtccagctgcttcttcacattgcccacgatatccgcacccacgatgtttccctcgctgtccacgatatatgtagtgggataggtggaaatatccgcaacgaagtccttgtagaaatcgccctccggatccggagagatattgtgataggtcacgcccttttccttcaaaatctcccgggccgtgtccagctgctcccggctctcgccggagtcggtacccacaccgatgaggttgatgtttcgctctttgaaatcctgatacagctcctccagttcaggcatctcggcgatgcaggaaccgcagccattgttccagaaattgacgatggtggcgtcatagtcggcgaaaatgtcgctggagatctcatcgcccgcaatgtccacctcggaaaattccgggaaaggtgtcttggacaccagggcgtcctcttcaccggagctgcagccggtcaatgcggcggtcatcagtaccgccgacagcaataggatcagaacacgtttcatgtggcagtctccttcttctcttgtattcttttgatcgaaaataccctggtgatggccccatgggggcaggcagccgcacagtccccgcagcggatgcactcagcatggttgggcgtcctgaacacatccacatccatcctgcacgcacgactgcacgccccgcaggcggtgcaccggcccgagtccacctgcaggcggcagatggaaattctgttgcacagcccgtaaaaggcccccagcgggcacagccacttgcagaaaggccggtagaaaaacaccgccagcagagctgtccccagcaggatgcagctcttccaggtaaatagtccgcccaggccggcccggatgcccgcatcggccagcgccagcgggatgccgccctccaggatgccggcggggcagatatacttgcagaagaacgggtcgcccattcccacctcgttgaccaccgtcataggcaggacaatgacgaagagcgccagaatcccgtatttcagataggtcaagatgcggacccgcctggtgctgaacttttttgcagggattttgtgaagcagctcctggaaccatccgaacgggcacagaaagccgcacaccacccgccccagcagcgcgcctgcgaaaatgaggaatcccaccacataccatgcaaactggaacttggaggagccgatcaccgcctgaagcgccccgatggggcacgaagctgccgcggccggacaggagtagcaattcagcccggggacgcagacggccttcaggccggtcctggagatccttccatgcaggaagttcatcaaaaaggggttggaagccagcgcggcccccagctggatcttccagcgatgcttgttttcagccaatgcccacacactccaaacacaggttgacgcccttgtgcaggaccatgtccgcttccccgcgccacagccccagtccaatcatcagcagggcggctgccagacaacagatcgtgatctttctcatatcagcccatagccgccatagcggcgccgccctctgccgccgtcccagactggaacgcggcgttccggctcatctccacaaaggcggccgcggacgcaggcagctcctctgcgtccacggcggaataccatgcagagaggaatgttccgttcacataccaggaggcgacgtttggcatctccccgtcctccaccatgcttctgttgctgcccacagctgctgccagagagtcgttgtagaggatgacggggaagggtgcatcggcaaacatctcgctgccggttccgcttttggtgcaaaccaggatttccgccccattctccgcaacgcccccatatccctccgccagtgcgttatagaagacctgcgtcccctccgcttccggatccaggaaggcaaagaacaccacatccccaagctgttcccgggtaaacgcctctccggacagggtggtcgtggcaaagtcgcccaccatgttgctctctgttttgctggcggcgggaacgctgttctcctcataataggcatccacccacgcctgatcgacccagcccttatccagggcgtcctcgatggtaagcgtaccagcctcgatggattgttccacatcctcctgactgggccgcttctctccgcaggccgccagggacagggccatggcagcggccagacccagcacggccagcttccgtttgttcttgcatcgcttcataaaaaacctccttgccgcacctgcggcggattttggacaggaggcattgtagcatggaaaacgtaaatttcctgtcaaggcggtcttgatggaaattttatctggatgtgctataatagccgcacatggaaaagggcggtgagtgggatgcggattttggtggtggaggatgagcgtctcctgtgcgacgggatcgcggaggatctgagactggaaaaatacacggtggattgctgctacgatggtccggcggcctgtgagcggctgtttgtggaaccctatgatctggtggtcctggatctgaacctgccaggcatggatgggctggagctgctccggcacatccggacggaacagccggagctgcgggtgctgattctttccgcccggtcacagctctcagacaaggtggcagggctggatctgggcgcggacgattacctgaccaagccgttcgccctggaggaattggaggcccgggtgcggacgctgctgcgccgggaatttcgtcagcgggagtcccttgtacaggtgggcgcgctgaccctaaacaccgtgacccgggaggtctccggccgtggggaaccccttcccctgacgccccgggaatttgccatcctggagcatctgatgcttcaccggggatgctggatcagccaggaggagctgatggagcatatctgggaggcggatgccaaccccttcagcaacgccgtgcggatgcacatctcctcgctccggaaaaaactgcggaagcggctgggccatgatccgatccagaccaaggtaggtcggggctatcgcctggccggagaggagacggcatgaggaaaccgatgtccctgcgcctgcgggtcactctgctctgcgcagccctgctgacgctctgctgcctcctgctcactgtgactaacaatttttcggccatccggatggccgacgccattcaggcggtgccgcttcttccggcgcagcgcgcagagctggaagacagtgtcagcctgcccatggcggaactgcatatcagcgatacgatccagcaggctcagggggcgttccacatgcagagcctgctggccatggttgccatcctggcgttgggcctgttcctcatataccggctggttggaaaagcccttgctccgttggacacactcacttgccggatccgggagcggacggctgcggatctggcgcagcccgttgagatccccgacagcggggatgaggcggccgcagtggccctggcgttcaatcagatgtcccagcggctgaaccaggtcttcgtcatgcagaggaacttctcccgcaacgcggcccatgaattccgcacaccgctggcagtcctaaagacccgaatcggcctgttccgcaaaaagcaggacttccgcccccaggccacactggagctgctccagatcgtcgagggggaggtggaccgcttgtccgccatggtgagcgaactcttggagctgaccaatctggagcgggcatcccgcggagagcggctctcctccggccagctgatccggagcgccgcggaccaggccgccccccaggcggaagcgcggagcatcaccattttggtggatgccgcgccctgtaccctggccggaaatgcagagctgctccggcaggcggtatgcaatctggtggaaaatgccgtcaagtacagcccggccggcagcgttgtacacatcgcgggccaccgggatggggaatggttccaaatcgtggttgccgaccagggacccggcatcccggaatcgctccgccagcggattttcgagccctttttccgggtggatgattcccgctcccgacagctgggcggtgccggacttggactggcactggtgcgggccatcgcggagttccacggcggcgctgtttatgtggaaaaatcccggggagcgggaagccgattcgtcctgaagctgccatgcgaacaggatcctccgccggattgagatccaaactgacgtcttttgtcagacgggatcggcggaaacgcctcgcggcagttattttcatgcccctggctgtgggcaagctgcctttccgtgcgccgccccctggggctcagcttttgggcggaagacgctctgcggagggaaccgccgtccggaagcctgccaccgacacgtggcggggcagtctgcgtacaacgtttgaagatatcagcgtctctgcaaacgcaattcccgttgcctctccatacagccctgtaatctgtgcgccacttacagcaggaaagcacctgaaatctaaagatttcaggtgctttttgcttctcagcggacagtgcgcatctgttttgggcttcgcacatcaagtttcctgcggatagcagcagcgaagcccgcatgacgcccgcatctctccaggaaaaatgtgcttccggcacacgcaattctccaatcggccccttaataaatgctgacagttcgaaaggatgtatacctccagatccgtcagttggtctgccgggctgttttccccgtgatgggctcctgacttatgattgatgcggcccatgacgatctttgccatgccgctgacccttgcgtattccgcgatctgcaccgcaggagccgtcccgtacaccatggaaatctgcgccccctgctgctccgccaagtgcagattgcagcgcagttgctttatattccctgtggtaaagaaattttgcaggacctgtttggtctggcgtttccgacagacttttcccacccgaagaagcctctccacatcccgatgcttggtatgccggcacccctgggtgttgttgtgcgccgcttcatccaccaggacagttggaatctggtcaatatcaaccctcccggagttgaatgccgcggtattcgtttttcttattcagcaagacctcccgtccgttcagcagggacaatgtatccggtcttacatgcggggctccacatagcccaccaccagatcagcgccctctttctgcgcctgatgcgccgcttacgacagggcatacgttttgctcacgccggccgcatagccaaaaaggatttttagcctccccggaggatcctccgcttccggatcgtgtgggaaattcgcgcattcattgtttgtccgtcccctatgtactcaccctcccacaactcgtcatagaatcaataccttgtcccgttatcgtatcacgcgtaatactaccaaaccgtgaataatggcgtcatgatcggaagatagaattggggcgctcccaccagcaggaaaacgagcgccagaatcatttggcgctcgtttcataactgtgtgtatcgtcccatcccaaaatccgtttggccatcagatagattcccggcttgtaaaggaccagaaccacatccaaggcaggactccggcgtataaagtccgtaatcgcttggccggcaatatagattgcttcttctcgtgggatgtgatattctcccgaaaaaataagtggaaacgcaatgcttttgcatccgctggtcactgcccttgtcatggcgcggcggtagcagtctgccagcagtaaccgctctcgctccgcgcctccaaaccagccaggtccggccacgtgaataatatagcgggccggcagcccaaaggacggcgtcatcacagaatgtccgataggacaatggccatgacgtcggcaagcctcctccagctttgcactatccgctgcggcgaaaattgcctcacagatccccggcgtacgcttcagttctgtgtttgcagcatttacaatggcatccgtggcaatatttacgatatttcccatccaaagatgatacggcataggtcttcctcctttacagcagagcaccgcataccagataccccaaagcggaaattccgctggcacacagcgcatacggaatctgagacaacgcatgatccatgttctcgatcttacagcagctggatgtcaataccgtggcatcggaatagaagcaggcatggctgccgagcgtggcgcccgagacaatcgcccccatgaccaggagcagatttgtgccgatgctctccgccagcggcagcaggattggcgcaacgatggccggaatcccccacacgctgcctgtactgaaattcaggatcgccaccaccagaaatgtcaccagagggaagatcacggcattgacatggggctgcaccagggtaatgatgtaatcggcaatcccgatatcggtcattgcctcctgcatgacaaacgcaaagaagatgatggccaccgtgggaatcatgttgcaaaagccgtgcatcgccagatcacagaacctggaaaagctcattttgcctctgggaatatagagtacaaagcacactgcaatcgcagcaaccacggccagaaacagctctccggaaatgattgccaagataatcaacacgcccaccggcaggataaagtccatgaggctgccctgtgtctgaaattccgactcatcctcctcgttgagcggtgcgctctccggcgaatagaccttgccggtctcctgaaggcggcggtaagcggtccgcatccgccccagcttgggaacaacgccaacgataaacagcggcacgatgataaccgctgcgatggcgtaaaaggcaaaggggatcacgtgatagaatgtctctatcgccgttccatagcccagctccgcaatccccggctgcgtgaaaaatagcccggaaaagaagattgcccaggtagagaacggcagaatggcacacaccggcgcgccggtggaatcgatgatgtaagacagggcctcccggggcacacggcgttggtcggtcagttttttcatgcaggtgctcagtgtcatgatattcaaatagtcatccacaaaaataagaatccccatgatccaggtgaccatcatggtggaccttggcccccggcagagctttccaagcgcccttgtaaatcccagtgttccatgggattctcccaacagcgtaatgaggctgccgaacaacgcgcacaccaaaaagacccattggtgcgaataatctgtcgccacgcggaaaaaagcatccatccagtcggtggcgatgtgagacagtgcatacactccctcggacgggatccgtgcagcgctggtaatcacataggtcagcagagttccaaagatcaacggttccagagtccgctttgttttcagcgcaaaggcaatgacgaacaggacggggatcagtgtccatattccatattccatgagtacaacctcgtttctaccacagtcgcatttattggagtgcttctggtgcccgctaaagtcataatagagcacttccgatgaagatagtgttagtttcccggctctgggataaggaatatattaagaacaccatttgattgaaatgacaaaatgataggccggcattccagtcgatggaatgccggcctctactgtacagcggatattcctttccgggcattttctgagtccggaatgtcccctgcgcaattcatcagctgccagtttatttgccacgctccagatagtctgccgcaaactgcgcatacagtgcggcccccctctgcagcaccggctcatggactgtatagcggtcgttgtggttccccaccgtcataccgagttcctcatttctcgttccaagaaaaccgaacaccgctggaatcttatcggcaaagaaagcaaaatcctcactgcccatcatctggggaagttctttcaaacacgcttccccatagagtttcacagctgcgtcatgggcgattttattcaactcttcatcatcgttataaagagagtttgcatagtaatcatattcaaccgtggcagtcgcgccaaaagccttggctgtgttttcagcaatccgccgcagccccgcttcaatcttcatacggaattctgcgttataagtccgggtggttccaaacagttccgcatggtttgcaataatattataccgctgtccggcgtgcatctctccgatatttactaccagcgggtttaaggggtcgttcgttctggagacaaatgactggatattgctgacaatcgctgcggcagccaaaagtgcgtccacacccagatgcggctgtgtcccatgggcggaaacgccatctaccttgattacaaagttatccacactggccatgcggggccccgcctgcacattgatgtatggctcctccagtgtcgcccacacgtgctggcccataatggcatccacgccatcaaggatacccgcttcaacatagtattccgcaccgtggcaggtctcctccgcagcctggaaaatcagtttgacgttgccttgcaattcgtctttcgtctccatcagcatctttgccgcaccgagaagcatggagatatggcagtcatggccgcaggcatgcatgacgcccttatttcggcttgcaaagggcaggcctgtcttttcctctaccggcaaggcatcaatatccgcccggagagccacagttctgcacgccttttcggcctttcccccccgcagcatcgcacataatccggtatggtccgggaagcgttggatctcggtatagcccattttctgaagctctgccgcaatatgctctgtggtctggacttcctcgaggctcagttccgggttctggtggcaccatctgcgctgttccacaatgtaatccaatgcctgttcagccagttctttatagttcataacagtcctcctatttctgaagaagcatctccaaaatcaaatcatcacatttagaggaaccctcattcccaagccgcacgaaatttctgatcgtttcttccgggtctgtttctacaattccatctgtcgctttcacgctttcactccgaagggccatagcggcacattggaaggcggcaaagacacaggtgctgatcttcaaggcgcagtctgccttggcaccgtcacagagcattccgctcacattcccaaacatattgtttacagcaaatccgatctgctccagcgtgcctccttgtagatacaccaagccgcaggctgcggcggcagcggcaatggtcgccccgcagagcccggagagcggtccgaaatccgcgtggatatgaatcgccatcaggttgctcagcgtgacggcgcgaaacgttctctcttcatcaataccaagactcttcgcggcagacaagatgggaactgttgcggtaatgccctgattgccggatccggaatttgtgatgaccggggcattggctcccgccattctggcgtccaccccgctggcagtcatggctacggcatccatgacaacatcgtgccccatcagccccgcttcctgattgttccggataccatggccgatattcagtccgtaatcacccgctgcgcccagctgcgcgatatgcccattgacttcgatggcctcttggatcatgtgtaaatcatcctgtcggcgatccatcgtctccacaaattcatagatcgtccggatattcagcgtcctgctgatctgctccggcgtgatatccgtttccatcgtctgcccgggcagctcacagcccaccctctggtggtcccgctccacaaggatcacattggtatgcgctcccttaataatggcgcgggactggtgttctttattcaccagttcaacttccacatacagcttgtccggatcaaacgcccttctcacgtccacatatccattttccacaagatgggccgctctttcaatgtcttccgggcgggcgtcatccacaacccggagctggcggtccaccgccccgcacacagcacccaaagcagctgcataatttattccagtatagttcgttccgggtatccccgcagacatcgcgttcttgatgatattcgcgctggccctgaccttgatatgctccagctctccatccaactgctctcgggcaatggcggctgtcagcgcaatcgcggcaggctctgtgcagccggtggccagcatcatctcatgattcaatatttgacaaatcagtttccgattcatagcgatacgctcctattctatgatcccaaccaacatttgattctacaaaagcggaacacttcgtgtcccgcttttgtagatgatatggcctttacaatcagaacattttggcaaatacgcttgcaatgataacggacgtgatcgtcacagtggtaaagccgccgacaatcatgggcgggaacatcttgctcatcagatattccttttcctccggggtcgccgccagagcgttgcaggtgttttcagtgataattgcattgggcgggaacccatacagggcagtcaatgcggtggcaaaggccagcaggaacgggatcttcagtatttttgcgctgacgaagcacaataccgccatgccagcaacaccgacaacaatcagaatgaccatcggcccgatgatgctgcccagcatctggggcgtgcaatccttcaggccgtcaaagatatacatcatcagagcgaacatgacaatgccataggaattgcttttattcagtgcgttctcatccagaaaaccaatgctggtgaaaataatgcccagaaccagtgcatacacagcgccgctgatcgtcatgttcaggccggggatgacaactcttcccagctgtgtggccagccaggccacgaatcccagcttgcccagcatcaccacaacagaattccacttggcaggcgtggggggcagcagtttcttgcgcggactctcggtggtttccagctttccgttgactgcatctaccgcatttgaaacgccggcaaccgacacaccgccgttccggtattctttcaggagctttttgccctccagctggaggcagaccgccgtaagcggataccccgcgaacccctggacgcagtacatggcgatagcaaacacagccgcttccttgaggccggcagcattggccgcctccatcatcgtcgttgcagccacgatgcctccggtgagaggaggcagtcccgcgacaacaaagctgcggtccatgagcagggggcagacgaacagtgccaggacgcacatacccgcaagtcccgcaaggcagaccacaatggtcttccactgctccagcagctgcttgatgctgatcacggtgcccatgtgcgtaatcagcagatagataccgattgtgctgccaaagggaatcagtacggcgtcgctgatcagcgtagtgggaaggactgtccagtagcccaccagaatgatagcggcagttacgaataccgatggaatccatgcttttgttgccgtggaaacgacctcgccaatgatgtacactgcagcgcagagcacaaacgctagtgcaaagttatacatgtcttttccccctctttacttattcagcacatatttcggcggcagaactgcctcctttcatggttttgcattctcccacccaatatgagtctgaccaattactgtgcgttgaaatccattgccacctgcgcatagagcatggcgcccttcaaaagctgtgcctcatccacgcagaaattgccggaatggtttggccaaacggctccgcaggcctcgtttccggttcccagcagtgcgattgctcccggcaccctctgcatgaagtaggagaagtcttcgccgccggtggtagccggattggatgcgaggcaattctcacccaggacagcaaccgcggatttttgggcgatggaaaccaccgcctcatcattgacagtgggcggcacgatgcgcaggtactccagctctgcctcagcgcggtaagcctcggctgtgcctttgataactctttccatccgttcctcaaaggtttcccacacctcattgctgaagcagcgggtggttcctgtcatatagctgttctccgccactacattccaacgggtgcccgcctggatcgtccctacggtaacgaccgccgggtccataggcgagatctcccggctgatgacggactgcaggttattgatgatggcagccgttacaacagctgcgtccacaccccgctccggctgtgcgccgtggcacccctttcccttcacagtgatatggaattcgtctgccgacgccatccgggggccggcttccagagaaaccatgccggacttcacatctgtccacacatgaatggcaaaacatgcgtccacgccgtccaaagcgccctgctcaaccatggacttggcacccagagctacctcctccgcaggctggaaagccagttttaccgtgccgcacagttcttctttcatgtcatgaaggatgcgggtggcggtcaggagcatcgcaatatggcagtcatggccgcaggcatgcataatgccctcgtttttgctcgcataaggcgccccggtggtttcctgaaccgtcaaggcatccatatctccgcgaagcaaaatggtcttgccgggctttgcgccttgaatggtgaccagcacacccgtctccagcccacagggccgccaggaaacgcctatctcgtccagcgcctctttgattgccttgctggtgtgatattccttggtgctgacttcaggatgctgatggaaatagcggcgcttttcgatcagatactctccgtattgggcggcgacctcttgcacattcataacaattctccttttctcgcgaattttttcgctttaaatggttaaatcattttgaactttccaaatctgattacttcaggaattccagagcaatagaaaccaaggtcctgatgcctgccggcataacatcctcccgaaccgcacacttgggattgtgcaggggcgccagctctccctcgtgtcctgcataaagcatcagataggcgctggggataccacccagctttccatagaagctgaaatcctcactgaaaggcattggatcgggcatgggaccaccgcgtcctcacccaattcctttcggaccgcgtcagcggcaagatccatcagctctttgtcattgaaagcgctgggatatccgtcggcatagtgaatatgtactgtatttccggaggcggcctcgataccttttgcaattgcctggacctgttccttaatcacgcttcgcacactttccgaatacgctctggtcacgccgccaaacttgacctccgccgggatcacattgggcgcgtcgccgccatggatgctccccagggagaatactgccatctccatagggtccacccggcgggcgacgatctgctgcatcatcacgatcatctgggcggcagccagcacggggtccgttgtattctgcggctgagagccatgtccccctctgccggagacggtgaagtcgaacaggtccacggaagttgttatgggcccgatgtggaacccaacctgtcctgcccggtgggcgtccggcagcacatgcattccatagatcgcgtccacatgggggttttccagcacgcctttttccacaagctccttggcgccgccaggtaatgtatcttcgctatgttggaatatcagcttgacacagcccgcaaaacgctctctcattccgcacaggatcttggccgcgcccagcatcatggatgcatgcatatcgtggccgcaggcgtgcataatccccggattctcactggtatacggcagtccggtttcctcctgcacgggcaatgcgtcgatatcgcagcgcagtgccacgcagcggcccgggcctctggctccatggatcaacgctacaacggcggttggtacaggccgttcgattgcatcaaccccgtattcctccagcttctttcgaatcagggccgatgtccttacctcgtttcttccaatctcaggatggcggtgaatatccctgcgaatctctaccatctccgggaaatattcctccgctctttcttttatcgtactcgtctcaaatttcctccttcctgcatggcttccggaagccattgtttgttcagcatggtttctatgtttgcgaagcaaacatagaaacagggatccctgtttccgacaatacgatgttgctttaactatactttatctataataatcctaaaccacaaagtatatcaagtcaatatttttctcctgacttttcctgactccagcattttgagcacttccttgttagagtcggagacccttttccgggtcttgtatcctatcggcggaaagccagaagcgcactgacacaggcggcaaatttccacatggcgaaggtgctctgacgcccgatcagatactcaatgcagaatgtagttgcaatatccgctcatcgtacgtccatccagcgcacgtttccaggcggtcaggcccattggtcttgctgcggtctgcattggtgcaaatgatctctgccccaccgcgccctgtgacggcgtaaaagcccgcagaacttattttataccacggtatagaagtcccgtacggtggcgcccggcacagatgtcaatgatctgctgccagatacggcgctcactggtccgaatggaattacctccgctccagcggttttaaaggagccgatgctgaaagtagtcctaccctgcctgaggcgttcatcacccaaggcaaagttcttggttcattactctttcagttcactggtggcccaaatgcggatgtgggcggcccgcagcgatggtccaggttgtaaaagcgggcttccctcgttttggtctttctatccatcgctccgtagagcgtgcttgttacatttttgcaacaactcctttgtcctgcaattcgcctttctggacgatattagtttcctttctgagaatggcttggaatggcgagaaggaagataagctctcactcttaagttcacgaacgtgatattataagaaatagtatttgcattcgccccgcaaaaagccgttgcaccgtgaaaagccttgagaatactgaattttttgccttttaggacactggaaaacacactgattttcggtgctgtggtgcccaaattccttgcggcgatataaaaccacacaagcaaatgtaaagaaaaatcagaattatcgagggtaaaagcactccctgcttttgccctcttgactgccgcacgagcagaagcattcgtacttgtcagcggcgggcgggtcccgttcatcttgactattgacaagcgggaatggttctgctgtctcaggatttatgcaaacctcaaaaaagcggcagaccactgcgggcagaactctgcggcgaaggtctgtcccagactgtccggggcattcaaaccgcccttcatgcagcactgaataaagcggtggaggaaaacggattttctgtaatccctcagatgggtgtaattggagcaacgggtgatatttgctgcatcccataaattgggtgatatcctacgccacccatgtccgcgctggtcttagagggctactgggcgcacgccaaaatgaaatttgacaagtgctgaatactataaaatttctcctacagccatcataagtgatgttgtactcggcttttcaagttagatcaagtgttggcggaactgacaccagaggaacggagtaaaaagcggttggagcagacaaacccggttttagacgcactgtagtcatagacaaatgagatgcaggtggaagcagcaccgaaatctgcaatgagaggagttatccattatctgctgaagcagtggccgtacctgatccggtatctggaatacgagcaactagaagtgagtgccaaccgcgccgagcataacataaagtcgttcataatgagcaggaagaattggctatttatcaatacgaatacgcccgctggtacgcagaccagcgcagttccacagtttcattgagccagcaaaggaaaacggccttgatttgtaccggtatctactttggtttcagaaaagtgcgctggtactgggccaaaatccaggctgagaatctggctcccgccaaggcctcttcggaatccaaaatgcttccataacgaaaattaccctgcttatattggcaaggcaattccaagcaccgttatctttaatggttacaaaagtcccgcccctccggtactgggccggagggcgggactctcgtatgatgaggcaatcagttcagcgggggattgcgcatggcgtccttatactgttcgccgaaagtgtggatggctcgcactaccggggtagccagctctgcgccggtttccgacaaggtgtattccactcgggcgggatctcgtgatacatggtacggataatcagcccgtctgcctccaactccttgagctccgaggagagcaccttggcggagatgttgggaatcaaatctacaaaatcactgtagcgtagatggccgcctttagactcaaaggccagcagatagagaagcaacagcttccacttgcctcccagtacaagcaatgaacgcatgacggggcaggtgacgatgttcactgcctcccggtgattggtgattttatctctggccatataccaaagacctccttctgcctgatgtcagtttgaaaccagtataatggaagttttcaaaaaatcaagtcctcgaaaaatagggtatttctgtaaaccggcgaggaggctggcagagttccaggtttttcctgacgttttcgtaggaagtgacaaagttttgcgttagattttggaagcggctacggcaacgggtcataaagcgcgccaataaaattagccaaaatccacaaaaaacagcagtgcttcggccaaaattaagtaatatactaaccaaaaagtaactagattggcaaaaagtgcggtcttacttttcactaagaacctgttatgatggtgtcaaagaaaagccatggcaaatacatacaaaggagaggttttatggtgaccaatgaagttctcaatacaatcctaagtcgcaaaggcgtaaagcaatacaagtcgaatcctgtgccccgggagctactggaggccatcgtggcagccggtattgcggcccccaacgccttcaaccggcaggcgtggcatttttctgtgataaccaacaaaaccctgctggaggagatcgacgcagaaaccaatcaccgcttaggggatgaagaaggctaccattccctgtacggtgcgccggttctgattgtcatctcctcggcccgggacaataactttgcaaagcaagactgctccgccgccaatgagaacatggccctggccgccaagtccctaggactggcctcccggtatctggatgtacccaacctgtacactaataccccggagggcgccgggtgcaaggagatgtgcggaattcccaaggactatgacacagtgtgcttcttgtgcctgggatattccgatgatattagcgaacagcccacgccaaagcgaggggatgtcgtaaattatgtagactaaggaaaggaggatcaggatcatgccgaagattgttatcagcgggatcagcgaggaggtggtacgcacggttgcccccggctgatccctgccgtggcagaggcgctggcgtgccccgtggagtggatttcttttgaatatgtaccctctgtatactttgcggcagaggcagacaaggagcgctgccccatggtggagatctactggttcaagcgacctgtggaactgatgcagaagatttccagtatcttctccgaagaattgtcccgggttggcatcaaccgggtgattattcagatcattgataccctgcgggagaattatttcgatttgacctacggtgccaaatagcctcattctatattatatttacaggaggattgatccatgagcagcaatgagtgtgcaggactccagacccagtacgatgtgttctctctggacaaagccgagaccttggcccttctccatggctgtggcttttcctatgaggagctaaaaaagccccgggttgccgtgttcaataccctcaaccccatgaaccccgggcacatccaccagggtgctatcgccaaggccgtggcggagggcgtccgtgaggccggtggcctgccggtggaattcaatggcaccaacctctgcgatagtatgctggaaaatcagaagtacaccctacccagccgcgacctgttggtcaatgatattgacctgatggtcagctatcaccggatggacgcactggtaatgattggcacctgcgacaaggtgctacccgccttattgatggccgccggccgtctgaacctgcccacggtgattgttactggcggctacatgaagcctggtaactaccggggcgagaatgtggacttcatcgacataggccccaacaagacccgcctgcgggacggcaaaatcactcaagccgactttgacgaactggtggacgtgtctgttcctggaggcggcgcctgctgcatgatgggcaccggcaacactatggccattatcaccgaggtcatcggcatgtctatgcccggcaactccagcacccccggcagaagccaggaaatgcaggagttggccaaggccgccggcaagcaggtcatgaagctctatgccaagaagatcactgcccgacagatcatcaccaaggagtccatcaccaacgccatcaagacctgcatggccatcggcggctccggcaataccatcatccacgttcccgctgtggccaccgagtccggcattgagatgaacttcagcgacatctatgccgccgccagcttcgaaattcccctgctggtgggcgtccgtcccaacggcccctacaatatggatcagtatgccaaggccggcggcacccaggccattctccacgagctacggaagcacctggataccaactgcatgtcggtaaatgaaaagaccatcggcgaaaatatttccggccacgagattctggccccctccatcatccaccccctgtccaatcctctggacaatcaaggcggtctggccctgatgcggggcaacctagttcccgatggcacctatatcaagcagtccgccgtaccggagtgcctgatgaagctccggggtcccgcccatgtcttcaacaacatggacgatgccaacaacgccctcctcaaccacgagatcaaggctggcgagattgtcatcatccgctacttgggtcccaaagcttcctatgactccgcctactggttcacctcccaactcaagggtagcgacctttataccaaggtggctgtgattactgacggctgcctctccggtgccgcttccggtgccagctttcagttcgccgcgcctgaagcagcccttaacagccccctggccgccgtacgcaacggtgacatcattgaatatgatatccacgccagaaccatgaacgtggagctcaccgatgaggaaatccagcagcgcatctccgagctcaccggcgaagagtacccccacttcacgggttatctgggtatttatcagaagggatgcatctccatttcaaaaggtgccgtgctccgctgatctctccactaccacacacattataattggaggaaacgaacatgaacaaaacatggaaagagctcctgtgcatggttctgagcgccgttatggtgctgggtctggcagcctgcggcagtagcaaggccgaagcctctgcaggtgacggcgatagcaccagcggcgataccgctgctgattccatcgtcctgaagatgtccaccgcccagcctgaggagcacattgcctcccagaccgccctgcgcttcgctgacctcattgagcagggcaccaacggtgccgtcaccgtgaagatgtattttgccaactccttgggagctcaggacgtcatcgttcagggcttgatggacggctccatcgacctgtccttggagtttatcgactccacctacaacccggtctttgaggtgcagagtcttccctttatcgcctccaacttcgatgagatggaatacatcttctctcccggctcccaagtgtattccctagttgacaagggcttcagcgacatcggaatcaagctattgggcgtctactgcgagggcctgactggcgtgtcctgcaagaacatgcccgagtcctataacacttgggatcagaaaaaagaacccatccgtgtgtggaactccgccgtggctaaggccggcatgaccgctatgggctacaacaccgtggccatgacctggtctgatacttacagctccatccagaccggtatcgtcaacggctccgtgggccagacctccctgggcgtgtacaccaacctgcgtgacgttgttaactatttcatcccctataacttcggtgccgagttcgtgcacctggccatgagttccacctcctggggcaagcttactgcagatcagcaaaaggtggtgcaggacgctgccacccaggtctgtaaggaaatcttcgactccgccgagcagactgaggctgatggtttcgctatgctgaaggaagctggcattgaggttctggaactcagcgatgctgaccgcagtgccattgcccagcatgttcgtgaagaagtctggcctgcccaagaagagattctgggcaaggaggccatggatgccatctatgccgacctgaaggcctgcgcaaagtaaataagactccctaggatatggaccatcaggctgattctgcgctccggcgtggaatcagcctggtgaaagaaaggagaaaacgcatatggaaaagctggacgctttcaccagatatttgggtaactgcggcctgttccatttctttgatgcgattcagaagtgggttctggtattcaccggtattattgtctttgttctgaccatcgccactgtgttcctgcgctatgtcctgaccatgaacgttctggggctggacgagattattctccttgttattttctggcaatactttatcggcgcagcccagggcagccgggaggattcccagattaaggccgacatggtcagcaccgttgtgaaaaataagactgtggtggcctggtgccacctgctggcccgaatcattgagtgtggcgtcatcggtgtttgcatcaagtggtctatagattacattctcaaggatatgtccgtcatgccctatactgtggtgctctccatccccctagtgctctcccatgctgtgatgttggtgggttttgccctgatgctactctatcacatttactggttactgacggagctcgtcaacgttggtacgctgaagaaggaggaacagcaggcatgattcatgttggaattgccattgccatcctgatgggttctctgttattgggcgtctccattccctttgcctttggcgcaggtacgatttacatgtataccatgctgggtggcacctttgccaccactttgccggtgggcttcaacggcatcaacaccatggtactactggccattcccaccttcatcatggccggcggcttcattgaaaaaggcaaggttggcgatgagctggtgtccgtggtagaaatgctggtggggcgcttccggggcggactgatgctggcggtgtcctatgcctccgccatcttcggcgccatctgcggttctgccgctgccacctgcagctgtatcggctccattatggctcccaagctgaagatggccggctacagcaaaggactctccgcagccctgatttcttcctctgccccgcttggcctgctgatcccccccagttccctgatgattatgtacgcttgggtttccggagaatccgtgctggcctgtttcctgagtactgtgatccccggtgtctgtcttgccaccttgctgggcgtggtgggtatgatcctagcccagcgagagggcgtgcagcccctggagaactgggtgcccatctactccgcccccggtctgaaaaagacttggcacgccacgccggccctgttgctaccggtgattatcctaggcggtatttacggtggcgtcatgacccccaccgaggcagcctgcgtctcaaccctgtattgcattcccgtggccatttacatctaccggggcatgaagtggagtgacgcgccggaaattcttaaggaaaccggcaccactactggtgtcattatggtgatgctgttctttgtgagcatgctgagccggtacttcatctatgaggatcttcccggcgccctggtagatatgatctatctctttaccaccaacaaaaatgtcattctgctgatgatgaatgtgttcatgattatcatgggtatgctgatggatgacggctccgccctgctgctctccacccccattctggttcccattgccaaggaaatcggcgtgagccctatccacttcgcagccattctgggcgtgaatcttggtatgggtaatgtgacgccgccctgtgcccccatgctgtatctgggtgctcgggtggtgggcaccgacgccagccactccatgaagcccacgctactgctgattctctttgcgtggttgccaacgctactagtcgtcacctatgttcccggtttctccctgtggctgcccaacatatttgggttctgagccgagaaaaattacggaggaatttctatggaaaagattacgaaaatcgaaaccgttgaggtggccatttcccgaaatggcatctcccaagctgttcgcttcggcaatgtcctcttcgtttccgggcaggtgggggaggacatccaaggcaacatccccaaaggtattgaggctcaagtagagctggctattgaaaatgcccgtcgaattctccgagctgctggctctgatttggataaggtgctcatgtgccgatgcttcctccagaagcaagaggactttgccggcatgaaccaggtgtatttcaagtatttcggcgacgccaaggtaggccccgcccggtataccgtagtggcacccccggtagcagactgctatctctttgagatagctatgttcgcagtagtggagtaatttacgggaacctcataaaagcgccccgtcgggcgaatgatatgaactgggccagtaaaagtggacaatagagaaaatgccccctgtgtaggagaataaacctatacagggggtgttcgtacgtcaagagaaaatgcgcgcatatccagaaatttgagaagggaactctggctatgcgcgagacaggagcaacgcgtcaatagttatgggggaacaccttgctccccgccacgcccgcaaggccgcacagctttttcatctctaccagatacatttccaggacaggcgctttccgtctctggtgagaaagatctcaccggagacgatctttttcattttggcgtattttcagtagcctgcggcagagcttttgcggcagtaagattgtccagcctagcccttcatggcgatctgtgccacgcctgtcccggcagcctccaccgtgatataccgcacctcgttgccccggatgccagtagcgcagattgtctctatcagcagtgccaggcggtccctgccgaggcccggatcgccgccagcatggcgttcaccgactccagccggtattccaggccggacagcccctcttccaggcggacaacagttccttggtagtcttccagcccgccgcccactcggcaaatccccgcagggaacgcaggtacgtctcgatggtccccgattcccgctcgtcgcggcacagaaattccgcaaaccgctccattgtttttccttcatcatatcagagtcttcctgctatcatacgaccggaagtcttcacagcttgttgatagaactgtcccttccagaaaaatattgcaagcggatcagatagttgcttctttctcaactattggggtgcgatggtgtctaccgcgccccaaaatgtctgtcataatcactgtggagtccacgcccttgtatacgaatcccaaacggggatatagtagctcagtacgttctgcatatttgccataggttgattgcagtggtcatttgtgtgagcactataataaagcagtcctgccatcgttactggtaagtgaaacgctcgacaacatcatgccagacaacgcaagtaacacgatcttccgttgaaatatcgctgttcgtcttattggtctcggacttacttatactgtttcagagaaactgtaatatcgctgagactggaaactcccttggcatagatgccgaaggccagtgtactctccaattcctccgcactgtcggcgatataaaaggttctggccagcgtttcgcccgcgccaatgtccactttcaaatccgcccagcgtgagcgtcctgcccgcagtcgcggtctgcatcgcggagccgttgttggtcacagtcagcgcaatgtagttcccatctttggggtagaagttggattccagcgaatagcagcaggtggtctggagcttggtgttgtcctgaattatgccgctcaaagacttgccggcggccttgactggatcgatctccgtaaacgggccgtggacgcctccaagtacgggcgttgttgcgttagcagggatactcccatcgcccctctttccacctacgaccacataatccgcaggggccgcgccaagattgacccggtttttctgactgtcccggcgcacttcaatgccgagcagtttggagatctggcggatggagagataattggtcttgtcctcggcaacatccacatagataatgaccgatggtaccccctgcccattgggcgctttgcaagtttcaccggcaaggaccttatcctcaccgaacagagatatcccggcctggttgtattccacccggctggaagctgcaaacacgctgcccacaagggaagccaccagaagcatcgccgccatgcccgcaacaaatgatccgtacttttttatcatgaaacctccattgtctgttttatatagcgagcatcttaaacttctattatgcaaatgcagaaggaggttctttctttacatctcttatattttttctgttttcgccaaagaaacgctctcagttatgtgcaaaatatcctcttaatcaagatgtgcgtccacacagaattagaggttgctacttatgtcaatacatgtaactgtgctttgctgttttttccaattctcttccaaaaacagttgtccatccaggccattcactgtgaccggaataatttctgcgctttccatggcaaaatcactcgtggccccctcctgcatatacacgtagtccaagtatatcgtttttttgagttctttatttcgataggtgttgcaaacatagtttggaaattcttctcgttaactctcaatttcaccatatccctccagtaagtccgtaatttcataccaaggcatatctccggcaatctgttctcccgaatgtctgtacgtgatatgtgtctcataccactccacaacccggcgcaccaccgcggcccgcaccgtttggctgaccgccatcaagctccccaagctcaacgaaaacacaagcaagagcataacagccttttgtctcacgcttttccataccggtcgtgcccgctttcgcgcgcacttcaatgggcctgtcagcatcgccgtcatctgccgccgataccggggcgattctgttccagtgggcggcaggttcccacctgtttggtaggccacgtaagtcctgtgatgcaaatcaaagataaaaccctcggaggtgaaacctacaatggcaaaacgcaggccgtccggaaacagcatggtccgcaagcgggagaacggccgctgggagggccgcatcgtggtgggtcgcaaggaaaacggcgacctcatcttccgctacacctacgccgacacccaaaaagaactgaccgcaaagctccggcaggacatcaccgcctatcaaggcgtggatctgacggaggagtgcagaatgcccctctcggagtggctggaccgttggctggagcagataacatccgtcctccagtccagcacgccggaacactaccgcagtgacatggagcaccacgtcaaactgtacttgggctagaagaagttcacacaaattacaccgacagacctgcggacgctctatgacaccttaaaacagcgtggcagaatccatccccgccccggccagagccgtgggttatccaacaccacggtccacggcatccacaccaccgcaccatgcgctgaagtctgtggtagaccaacggctgctgccccacaatcctgctgaccatgtggcgccgctcaaggtggctcacaagtccatgaccatcctgaacgaggagcaactggatgcttttctgacagcggtgaaacaggatgctgtccggaaagccttcttctacacggagctaaccaccagcctgcggctgggtgagatctgcggactgatgtagtctgacttcgatttcagaaaaggaacactgagtgtcaaccgaaccatccacaaagaaaagggctggcaactaatgaccggagataccaagacctacgccgaaaccaaaaaaatcgtcctgcctgacagcaccgcagagttgttacgaatccgaaaaaatgttcctactccgtatggttctttcccaacccacccaaaccagaaacacctatgaatcccgccactgcttatcatcaactgaaaaatatccttgcaaaaaccaagttggagtgcgcagcaaagctggcacagctctgggatgcgctgaaagaacctacactagaccaacctaaacccgaaatcttgctggcggactggctggatctctgctatcaagaatataaaaagccaaatctcctcccaaacacgcaaatgtcttatgagcggcggatctatcagcatatcatcctaaagttaggacaaatccaaccggacaagttgaacaccacagacattcaggaattctatgtgtcccttaaaaaggacggcaggctgatccgagttgagttctacggcaaagggctgtcagattaggccgttcgcagcatccacacgactttccacgctgctctggacaaagctatggaggaaaacctgatcttccgaaatcctgcggctggttgcaagcttccctctgccaagcccagagaaatgaaggtcctgataccggaggaaatccagcggttactgatccaggccagagaggggctgctatgaactgctcctgccggaactgtccacaggcctgcgccggggtgagatctgcgcccttcagtggaatgacctgaatcttaaaaccggggcactccaagtgggataataggtccaccgggtacgtggtgagttggtagtctccccacccaaaaccaaagcaaggcaacatatggtgctcctccctccgccggtcctgaatgtactcataacctatcgaaactcctgcacttcccggtggatgtttccttcaccagtcaaggaggattcccccacggacccagtcactatacaaaaacggctgtctaccgtactaaaacgagctgactgcaagagacttcggttccacgatctgcggcataccttcgccactgcctccctggagcacagcatggatatgaaggccctttccacgatcatcggccatgtgtccagcagcaccacgctgaacatctacgctcatgtcacggacgagatgcaaaggactgccgtagccaaaaaagaccgggggatcggcaaagctactcccccatcgtcaatggaaagcgcatcgcccgcaatgtctacgcccctaccgaggaggaatatgaacaaaagctggccgccctcatccaggagatgagagcaagagatcgccacagggaaggcacaggcaatggcgggatgaaatgcacagggctccggcggttgttccgccggagtcctaattttttctggttattgctgccagaggcccggcagatacgcgcttcaaaataggttgccatgccgtttccctttcctgccaccagcaacttggcaggcgcttttgcaatcacaagtgtatctaccagcaccatccgggcaacggtccagaaacagataccgatcaaattcaccgttatctcggtaaatcacgctcaatgagctacagggggatctgtcgaagccaccgtagaaatgatgatcgccggtaatcccgcataatacgcgatacccttggtcatatcctgaattctttctccgccgattcccataaccactgtagcggcctggaccttaccctttctactaggcggtcaatttgggactgagagcattctccctgaaaaatctcataccgaacgatataatccgtaccggcaaaaaattattccaacacaggcccgatccgccggggccaggactcactgatcagtatgagcaggatctttcccattccctgcaaatattgatccaattgctgtagcatacctgtactatggacatactttgatgggctttttttaattatactcatagtctgttcctccgtttgtacaactcattattccataaagctgggaagccagaggcaaatttggggaatataggtaataagcagcagattcaccaggcagcaaatcatgtacttcagcagatgccggttgaccagctcacccaccttcgcctgccgcagagtcgccgccacatagagattgatccccagcggcggggtgatcatgccaatgcacatattcagcagcataatgatgccaaaatggacaggatcaatattgtaggcagagagcgccgggaacaggataggagcaataatcaggatggcaggcgtggtatccatgaaacaacccacgatcagcagcaacacgttcaccagcagcaagaacaccaccttgttagaacagatgctcatgatgaactccgccgcatgggcgggaatctgctcacgggtcatcagcaggccgaatacgccagcacaggcaacgatgaacatgatcataccagaggaggcagccgcagactttactgtttccaccaagcccttgaagttgatttcccgatagatgaagcagcctacgatcaggccatacgcgcaagcaacggctgcggactcagtaggtgtaaaaataccggtgtagatgccgcccaagatgataatgggcatgaagatggcaccaatggcatgataagacgcagacaaaaattttctgatattaaacttggttctagggatccgattttttacgccgtagaaaatcgcaaaggcaatcatcagtgcacccagcgtgatgccgggaacaattcctgccatgaacatactgcccaccgatacacccgttgcggagcagtatgtgatcatcacggtgctgggcggaataatcgtgcccaacataccggctgcagcaatagtggacagggcgaatttgcggctatagcctccctgttccagcgcaggcaccatcactgcgccgatggccgccaccgttgctgtgggggagccgcacaaacagccaaacagcatacatgagaaaatcgtcacgacgccgaggccgccgggcatccaaccaactgcagcattggcaaaatcgataagtcggcgtgaaatgccaccactgctcatcagtgcgccagccaacataaaaaacggaatggccgccagtgtaaaactatcgacggaggagaacatcttctgcacggaggtgaacagcggcatcaagtccccggcaacgatggccgccataccgccgcccaccagcgccagcgcgataggcatacccagaatcgtaatgacggcaaaaaccaggaaaagcgttgcagtaatcatgcttcaatctcctccttccgatgcataatatccttaatcatggtttcaatgctgtaaagatagtgaatgattcccataaagaaccccataggaaggcagaagaacacgaccgcagtgggaatctgcgtggttgtggtcatctgcttggtcatgatcagatgattaaacatctgcagcgaaagcacaaacagcagcacaaacatcagcatgcataggatctccgtaaagatccggacctttttatagatcttttccggaagcatatccacgaatacttccacaccgatgtggctcttactttttacaccaatactggtgccaatataaacgatataaatcatgaggtaccgggccaactcctcactctgcagaaaagggatcttcaaggcatagcggcaaataacgctccagcaaacgatggcaaccatcgccagaaaaaggacaacactcaggaagccttccactttgctgaaagcctgatcaagttttttcaacatggcaaactatgtatcgctcgttttccggcgatacgctcctttctcccgaaatgaggcggagcggcggcaaccgctccgcctctgttctcaagttttttgtgtcttattccacagcctcgacatccgtctggattgcctctaccagaacaggatcgatgccgccctctcccacgtacttctcatacacaggctgcaccgcagcttcccactcggtctgatcaatctcgatgaactccgcgccattggcctccatctccgccatgtactccgccaactgctcatcacagatctgatagtggtactcacgggcttcctctgcacactccataaccagctgctggatatcctccgacagggaatcccagagagatttgctgcaaatcagaggagcgggagaataaccgtggttgctcagtgtgatatagggagcaacctcatagaagttctgggtatacatgttggtaaccgcagtggaactgactgcatccgctacgccggtctggatggaggtatagatatcaccccaagccagaaccacgggcatagcgcccagtgcgctgtacacatccgcctgcagggggctgtcgatggaccggacacgcattcccttcagatccgccagattcttgactggcttcaccgcgccgatggcataaatgccgttctcccaatagttgatgcccttcatcccgatggactccagggcgtccagctgcccctgagcagcctcaccgctgagagctttccgtgcggtggcagcatcggggaacagatagggcaggtcaaacacggacatggcatccgtaaagttggacagggacgcagaactctctacgataaaatcaatggagcccatctgcacaccttccagcgtctccttggcggatcccagcgtagcacccgagtggaccgtcaaggtgatggcgccgttactgcgctcgttgagcagttcagcaaatttcagaaggccaagatcccaggaacttcccaccgcaagtccgctggacgccgtccactcataagtttgtccctctgcgctttcaccgccggagctatctccgccgcttccgcaggcagtcagggagaacaccatggccatagccagcaacagacaagtcagtttctttttcatatgctcctccattaaaccgttatgtgaaacctgttatgtgttatatcacttgttgtagtagataggccggcccttctcgtcgtgatccttgtcgaatgtgggataagctccgccgttgaagccgttgaagcccaagggattccggaagcccagaggattgattccaacaggatgtctttccagcaggtctttgatgaaggcgctgtaaccttccacgaccttctccaccagtgcatcgcccttttccttgctggccttggtgggattgccgatcacgccgtagtccagatcgtccttctccatcagagcaaaagtgccgtcgaaatgataaaactggaaaggatgagaagtctcgccgggcgctttcttccacttgccgtccaccagcgtcgtgccgccgccgtcgatggccaggtccatgtggaccaagtcgccgtacagggacagcgccatggaggtctccgcctcgtcggcgtgccacatataatcggacagaacggctttgttgtcgcccaggaagtcataccaggtagaggcgaccgtgaagtagccttccatgcccagcttgtgaacagccggaatgaaggagctgtcctggccatgggcaaccagcaggatgaacttgttatagcctacattggaggcaccggcgatgatgtcgtgaatcagcgccatgttggtctcatagttcagcgcgatggtagcaggcatacccatgtgcatgtagggatgaccgccgtacatggggcaggggagcacggtggcgccggacttctccgccaccttcttggccaggcagatggcgttgaagctgtccaggccgttggggcagtgcgggccgtgctgctcaatggcgcccaggggcaggatcgctacgtcgttgacttccttggcataggcgatgttcacgggagcggtgttctgatcaaagaacacggaatctcttttgtacagcttgaattcagtctgcttcttcagttctgccatgataatcgtttcctttcttaaaaaaatatagatggttttttaaatcagctgaaactcagcaggatttacagttacggctggaacaaaatcttgatacgcatttccttctttgcccgaatcatctcgatcacgttctggaagtcttccagacgcttgatatgggtaatgagcggttttaccttcagcttcccctctaccatgtagcgcagcaccggcgtaaaggagttggggctggccagagagccgatgagcgccgcatcttttacgatcagcgtgttcatggcaacatccacattagctccattgtaccagctgacagctacgatccgtccggtgggcttcagggcctgcaccgccatattcagtgcgacgttgctgcccgatgtctcgatcacgatctcaggaccgccctcagtcagttcccttgcccgctgtatcacatcctcattgtgatagttgatggtctcatggatgccgcactcccgggcgatagccagcttctcatcccagctgcctgccatgatgacccgactggcacccgcaatattggcaagctgtgccgccagctggccaatgggaccatctccgatcaccagcacctgggcgccggcgggaatctgcgccttggtgaccgcgtacatggcggttgcggcaggctctgccagagcggcctcctccaagctcagcccttcggggatatgatacagatgccgttgcggtatcgccacatactgggcaaacacaccctggcggttgcggtaagatcctacgacctcccggttggggcacagattataatggccctgccggcagttttcgcactcgccgcatcccaagctcacatcggaggtgacctggtctcccgctttaaaatcccggacattcttgcccacagccaccaccgtgccgctccactcatggccgggaatgatggggtacttggtgttgccgtttttgatatggatcatctctcctgttagcagttcaatatccgtagcacagaacccggcataagcgatctgtgccaagacttcgtcatcccgaatctcaggctgcgggatctcggaatactcgattactcccggatccatgaaccgaatggctttcatcaggcggtctccttctttctttcccgatttgtatgacattgcatcgttcgaatctccccctgccggaagcagagcggctggcaagtcccttttaggagcagctgctcacaaaactgaccgggaagcccgccgtgctccataaaggtccagaagtggcagggcactgcatatctcgcgccagtcaattccgccgccgccgctccttcctcagcgttcatgttgccaaatgcaccattgacagacagcaccgcaatatccggctcaaagatcctgatctcctgaaacaactccgagtgaaacgccgtgtctccggaaaaatagagccgatgacctgcaaacgccaccaagagcccgatagcatccggcgccatggtaccgtgatccgccatcactgcccgaatcaggatcttttcatcctgatagcattctcctctgtccagacgatggcagcggtgggcctgtatgcccagttcaatgaacttctcctgacagctggcaggcccgaaaaacaaggtcctttttgtgcactgtgccacaattggaatcgcatcataatcgaagtgatcaaaatgcagatggctggtcacataataatctaccgccagctcttccggcgcgatcagcatgggtgagagtcgtttgaatcctcgaatccgctcgccgcactccgtcagatagggatcgagcaccatgcttgttccgtcgggagccttcaggagaaatccggcctggccaagccagcaaattcccagatgatctggaggaacttgtgttccccgaatttcctctgcgagattcatcctactacctttctcagttcctcaatataagcagccctcaagccaggaataccgctcgtcaaactggaccttgtacttcttcgtatcgccagccaggccccacagcagatacgcacgggtgccgggcagtgccaccgtggtgtggtagccggtgggcagcgccacggcggtgttgttctcctcgatcacattgacctcgtcccagatcttcttgttctcgtccgtcagatcatagccgtgctgcatgacgccgccgcggccagggccatcctcggtggaggtcatctggaaggagaagatctcatccaacacgcactccttgccggggcgctcgtagtcgtgccggtgcgccgggaatccgatccagccgccgggcacggacacggtctcgcccacgatcagcagcttggtgatgtggtcgttgtgcttgccgggctggccgaagatgaagcggtacttccgcttgtagatgtactcgccgggttctccctcctcgatattttcaggcgggcagaaatagggggcattgccctcctcacaataggcggtgaaaactctcgcctccatgcccttctcgctgtacagcttcactgtggctttgggcggcacatacagggcggtgggcagatcgtcatagacattgccgcgctggcccttggcgccgtccacaacggtcacgccctcatactccacccagcaggtcatgtcgccctgctgcagcacgatggcctgctcctcaccggtgaccttgtactccagcgtctggccggggttgagaaggattcggccgaatccctcataggtcatatccgagttggccttggagatcacgctctcatagccgttcaggtcctgaaagcggtatacagttgtgtaagacatttgcgtccactcctttttccttgatttgaatgcaattatttcaatacttccttgttgacgggataggtgaccggtttgccggcgagatactcagtgatcccctgggcgctgtccatagccatagcccgaagcgccccgttgctgagtgccgcattgtggggagagacgatcacattctccatggagaagagcggattgtcatcagcaggcggctcctgctcaaacacatccaggccggccccggcgatctcgccggacttcagggcctcgatcatggcggcctcgtcgatcacggcaccccgggcggcgttgatgatgaaggcggtgttcttcatagccttgaactgctccgcacccaccagatggaaggtagaggggaacagagaggtgtggacgatgacgaaatcggactttgcatacagctcctccggcgtcgccatggtgatccccagtccctcgacatccgcctgcttcacatagggatccgtggccagaatgttcatctcaaagccggagagcttcttcaccaccagccgggagatcttgcccatgccgatgatgcccaccgtggcgcccttcagctcgatggtcttgtaggtgttgcgctctttgaactggccggcccgggtcagctgatccatctgcaccgtccgcttggacagtgccagcagcagcatcacgatatgctccgccacggcgttcaggttggagaagggggcgttgaccaccaggatccccttttccgtggcgtgatccaccgcgatattgtccacgcccatgccgtgcttggcgactaccttcaacgtcgggatggcgtccatgatctccgccgtgatcttcgccgagcggatcaggatcgcggagcagccctgcgcctgccggatgatctcgccgctctccgtggaagtgccctgcacgacctcgaaattctcccggagatacgccaccgcatccgggtggatatgctcggtcagaaataccttttccatgtttatgtacgctccttctcagccgcggatccggctgatggtctccttgccccacttgacgatgatcccttcgtcagaggagagcagaatatactgcacgcccttggccatcagcgccttggccgcctcggcggaagccgccgtggtgcccactgccttgccggctgccagcgtcttggcggtgatggtgtcgatggctgccttcacctctgggtccgtggtcttgccgggtacaccgtaggactgggacaggtccatgggtccgatgaagatgacatcgatgccgtccaccttcaggacctcgtccagattctccacacaggtcttgctctcacagtgggagacgatcatcgtgttggcattggcggtgtcgatatactcctgcacgccgcaggtgccgtagtcacaagcccgcacgctgggggacaggccccgcacgcccaggggggtatacttcacataggacaccaggttccgggcctgctccggggtatccacattgggcacctgcacgcccgcatatcccaggtccagattctgcaggatctccacctgctggttctcccgaacccgcacaatgggcgtgatgccggccgcgtccgctgcccggacgatgttgctcagctgttcccggtccaccgccacatgctctgtatccagtacgaagaagtcgaaccccgccagggccagcagctccggaaccgcagggtccgtcagcttcacaaaggtgccgatggcactctcgccattgcgaatcttctccttgagcatattcttgcgcatttgtatgacttccttttgtgtaaattacaggttccggggcgaggccggatttcggggcagcgcgttcggtgtcttactctagaaaagccgccgccttcaccagaaaaagattctgctgaatagggacattgctgtcgcgcagcagtgcatccgttttctgtcagccaccttgtctaagtttctcccgcctcctgcggttgctgtccgccctgttattaagcaatatttatgccaaagtgataattctgccgaaaacgaattttttcgtgaggttcacacaaaagtctgggacgaaattgtgcatattggctataaatgccgcatatattcgtgcaaaaacaatgcatattacagacaaccgcactcttcatgtgcgcaaaattgcatcagcgttgctattttgcatacgagatgacggagaaaggtttccctctccccgtcatctctctttcgaaccatttacttattttgttttctggaagacatgtccttataaagctgcattttccgggtaatagtggacggattgacatccagcgctgcagcggccttgcgaatggatccgtatttttcgatggcgcgttcaattgccgcatattccgcccgttctactacgcttttcaatgaaaccgtttcctcttcttcctccgcagatacttgctgaggccgccgaagcttcagtggcaagttctcccgccgaataatgtcgcccggagtggtaatcaccaaattttccagcagattttccaactcccggacatttcccggccagcaatatccttcaaacgcatcgatcgtgtctgaatagatagatttattggtgtggtatttctggttttccaccatgaggaaatggttaatcagcggaatgatatcctcccggcgctcccgcagcggcggaatgaaaattgaaaccacattcagtcggtaatatagatcctcccggaacgttccctctctgaccatctgttccagattgcgatttgtcgccgcaatcactcttacatccaaggcaatgggttctgtcccgcccacacgggtcacttttttttgctgtaagacacgcagaagctttacctgcatatgcaggggcagatcgccgatctcgtccaaaaagaccgtccctccgttggcggcctcaaacaggcccttgtgtcccttgttgtccgccccggtaaatgcccccttctcatagccaaacagctcagactctatgagattttctggaatggccccacagtttacctgcagatacggccagtctttccgggggctgttgtttacaatcagttcagaaataatttcctttcccgttccggattcacccagaatcagtacggtggctccatcaaatgcggccacccgctgtgccaatgtaataacttcgttgaacgccttgctgtttgcaataatggtcccctcacccaggcggatccgcatgctctccagttggcgggactgctgctggataatcgtatccttgctcttcagactgttctggagttcattgagggctgtgatatcccggacattgttaaatacatatttgacatttccgacatcatcgaaaatgggtgtggccgtagccagaaccgtcagccgcgtgtgataattgtagctgatttttgaaatctgctttttttgccggataacctccagaatgacagaattggaaaaaatcttttcatccagaagctgttgcgtcgttctgccctccagttccgctttgctgacccccaggagcgaggcattggctgaatttgcaaagagcactttgccttctccatcggtaatccaaacaccatcaaagaggattccatcatttcaatcaaggcattgctatcaatcacggcgtatctccttttatatactcgcagctgcatcggttctaccgacaaatcattataatatggcaaaaatgcccaattccgcaaaatttccatgatatatttattgctattttatcaaatgcggggttctctgtaaagtgcttgcctttatatctcacatttcatgtttttcaggagaaaagaattgtcttcatggagcaacatcctcataacgagcaaaaagtatttaacacaacgaatcgtgacaaggaaaacttctccaacaaaaggaagggcaaggggaagcacaaaaaatggaatcgtaaaaattctgcaaaactccgtcatgaatgcttttggcttctatggctgtatcggctccgagcatttccacgtcgggccgtatgccttgacttgaagtgcgtttataccccatcttctgtaaaaaaattggttcatacctaaaactaaacggcgtagactgcatacagtctgcgccgcttaatttttccttctttatcatgattcccgcagccaggcagcgtagtcttccggggacagcctccccgcttcgcactccgcttttttctctctggcacgttcgtcccacgcgtagagctcctccggctccagctttcccgccttcatgcgagcaaagcgattcttgtattctctgcgatagtcctgaaacaaggcatccctgctcttccgtttcgtccacagggcaatggcgcccacttcccggcaggtgcggcctttctcgtcaaaaggccggctacaatattcggtgttggtacggcccgtcagggcaaagtatctcccgcagtttttgcacacccgcatcttcacttcccgcttgatgcactcccggaggtggtagtcaatgaggtcatagaccacctccggctccaaaacctatgcaaacacttcatcgtcgatgagctcaaagccaaccggctgcacacagaaccgaaaggcacggtctcctgctgccttgtagtaggagaccattttctgcggtaccgtttcctcggactcctgatccgtatccaatacatgttggatcagctccaggatctgagcttgcatctgccgaagcttctccggcagatgatacagatacgcccggggcagcacgtcctctgtatagctattgaatagcttggcatgggtaagacggcaattcatatccagccgaaactgctgaaaatagatgtggcgcgaagccaagtcatccagcagcgcaagcgcgttctggtgatgttgctcttctttcgttgctgccagtttccagaactcgtcattcaacttttgaataatggcgtctatggggtccaggtccatatagagcagcgacatcaagctttccgggaacgggactgtctcagaaaacgtgaccgcttcgccaagtgtctactcgctgtaaagatagtgctcctgctcatgggcgatataggttttgaatgtgtacctcatcaaagcaatgtgccccaccccagactaatttacaaactgttcattaattggtcttgacgcaaagagtgtggtttgttacgcccgggttaggcgagcaatagaataatgcctttaaaaccaagtctggattagacagttagaaaaatcaagaattctatctggccgcgattgtacctcgataactgcatacccaccaccaaagccgatacttgccggaaagagtgccgccagaactctgctgtcaagcaacaggcgcgcccactaaggcgaaaggaaacgccgtgcgtgacaaacaaggccgcagagtaggaaccggtacggcgtgcggcccacgaatttttgtaaaggaggtgcgtgtgatcagcgtacaaggtccgcagcaaaaggaaagccgccgaaactgctgcaacagtccgccggcacgccgcgttccgaaaaacgcagattccatctgcagacagtctaacagagaggcttccggaacgcaagattttgttctctgaatttcgaaaagaacacggaggtactctatgccgattctcggtgaacgattctatcaaataagcaatgccatcttctgctatgacctgaaaccgatcccgctggcggtatacagctatctggtctgctgcgccgggcagaaagaactttgctggcccagcatcaagaccatcgcactgcagctgttcggaaaacgttgcgagggacgcagtcaggcaattagtggatcgcggattcatccgcaaggcggcaaccaacaagctgatgcgccgcgacggaagttggcggcagagcaacaaccactactacatcctgccgctgcctgcgctttccaccgcagggcatcgtgcaagcaggaaatccaccacaggagatgttgtggaggaagtgtatcagcaaaacaaaggatagcaagggaaagcccgtgagcccagcaaagccctttgtagagcggtttgggccccagtaagatcccagctcctcccggggattttggacggatttgggccgattttgaggctctgcggaggacgaaaaaacaggagaaagccctggcgcttttatggcgcccaggcagtcacttccgcccgcagtgcgggtggttttcggggacatgggctgacgcttttccggaacgcccaaactacgattgacgctgtttccagagaagcagacgaatatccccgccattgcgggacattcgctgacgctatcacggatttgggaggtatttgacaatgggtgaaaacagacaccggcacaccgtctggatggacgatgccgtgtgggatcaggtggagtcccactaccagaaagacaactgctccaccaaaaatgagtatatcgaaaaggcgattcagttctactccggctacctgaattcggagcgggccggcgattacctgccccgggttctggccgatgtgctggagggcaagctgggggccctgggcaaacggatgggacacctgctgttcaagctggcggtggaggaggccctcatgggaaatctggtggccgccgggatggacgtggctctggacacactgcgtaagacacgggtccggtgcgtgaaggaggtcagagaaaccaacggtgagatcgacatggatgacgccctcgcctaccagaaaggggtgtaggaatggagggactgattcagaagtcgggctatatcaagtcgggaagcggcggcggacactacgctgaatacatcgccacccgggagggtgcggaggagttgaagcccggcggctacctggagtatatagcggagcgcccccccggtcccacggactgttctccgccgatagtcccgccgacctggagaaaactacggatgagatcaatgggcataccggcccggtgtggaccctcatctactccctgaagcgggaggatgccgtccggctggggtatgactccgcggagagctggcggaagctgttgttggctcatcagacagaactggcccaggccatgaaaatctctccgcaaaatttccgctggcgggccgcctttcatgacgaaaagcaccatccgcacatccacatgatggcctaatcgtcagcccccaagcaaggctatctcacggaaaaaggcatcgagcagatgcgttcgaagctgtccaatgagatcttccatgacgagatgctgtccctctaccagcaaaaagatctatcctatcagcaggtgcgggacaccgcgatagaggccatggggcggctcattcggaggatggaaacaggtctgtgccacagtccggtcatcgaaacgcaaatggaaacgctggccggaatgctggaaaactacaagggcaagaaagtctacggctacctgagaaagccggtaaaagcccaagcagacgcccatcgtggatgaactggccaggctcccagaggtggcggagtgctatggacaatggaacgaacttcgggatgaactagagcgctactacaaggacgcgccgagagagcacaaaccattctcacagcaaaaggagttcaaagccatcaagaatatggtcatccgggaagcagaggaattgcgcttaggtgcctttaccttcgaagatacgaccatgaaagacgaagtggatgaggatcaggaggcggtgtacaacatctggaactcccgccggcagatgtcttaggcataccaggctgccaaggaaatcctgtcagagtatgaaaatacagagaaagaaaaagcagtacaggtgcggatgctggagcagctctggaatgccggcttcaccgtagcggctcatctgctgaacaagtgctggcgggacagcatgggcgtgcttccggatgacgaacaggcggagctgtggttccgccgtgccgctgaagctggtcatgacttctcccagtacgcccttggtaaactgctgcaaagtcaaaagcgaatggatgaggcggtgtctcggtatgaaaaagcggcggcacaggacaattcctacgccgactgctggctgggaaagctgtacttcgaaggaaaagcggtctcaaaggatgtacccggggcggtggaccacctcaccgcctccgccgaacagggcaaccagttcgcccagtatgctctgggcaggctgtatctcgacggacgggaggttccgcgggacccggatcaatcctgggactggttctctgcgatggcggaacagggaaacaagtacgcccagttcttcctggcgcacttcaatgacacacagtcctcatatgcttctggccgccaccaagctgcttcaccacctggggcagatattccaggacaactccgtgccgcctgccgcaccggcgggacatggtgtggaccgaaagctgctccgaaagatcagggcgaagaagatcgtcatgggccacaagccgggtgaccatgaagatctcgagctaacacaaggcggcatgggaggtatgacaggatattgataggaccggaggatggtatcaaaatgtgataccattgaactgcacccccagagatagacaaaagtgataaaataaaaaaaggggggtaaatatgccaaaaggagtgccaaatcgtaagcgtaaaacagcgggaagcatcaacaaaagggcggccgcatggccgcctttttgctgaataggattcgcaggattaagagaggatcacttcttgcgaaagaaaatcatgtaccacatccaaaaggtgctcagggggaagttggagacgagaatcttttttaacgagcaaggccacagcgtttttgccgtgggatagggggagaaaccacagaaattgtggcccagccatctggaaaatgaccttgtactagaatgccataggaggaagtgcgggatggatgtatctcgtggaaaaaatatttgtaaagaacatttggtgaacatttggttctttggggatagtttcattacgctcaagaccattcaaaggggtgtcttgcttacgtatggtctggcgctttaaatattccgcaagccgtataatgaaatttttgggtgtaggacgttcaaccggaagatggttgctatagacttgccgcaggatctttttgtttccagtctcccaaatgttagttgttgtacgtgctaaggacctggatacagtttttgctttctttccagtctgttgctcgaaagaatccgatgtcttacccagatgcaaggcttctgtcccaccggtcatgaccagagagacaacacccagcagatcgctgctacctaccgaaccgacgtttccttcaatttcaaaaatcaggtcttgtgtgtcctccatagaaaatacctccggtaaaaaatttgacgttaaatctgtagttcgcaaattcgccgttttgagacaaaaagagacaccagaaaattcagaaacctaaaaggaaaaagagcctgcgtatcagcagactctttagcgtacagtcatattttcacagggatatcccaactgctttgcggggcgttctccggcaataatttctctgccaaattcttttcctctgccgcgagtttcggagcatctctcagaagccaggtcagatactggtatggggagagaggattctccttggcagtctcaatcatgctataaacaattgcactgctctgagccccgccttccgtatttgcaaacagctagttcttccggctcattacaaagggtttcacactgcgttccgcacggttattgaagatctccagctgcccatcccccagaaaccggatcaggtatggccactgttcccgcagatagtacagtgccttgcccagcgcggacttcggcacagcggcgctcttcgtttcagcccatgtcaataaagcgtccatcaccggcttggaccgggccagacgctgttcacaccgttcttccggcggcagccctgccaattcctgctcaatcccgaagaggcattatccagcccctccggtgccgcacaacctgcgcgttggtccttcggcagggcatccaccgcctcatcgaattttcgccgcaggtacgcccagcaaccaaccacccggatgtttttaggcaaccggtggtaaccggagtagccatctgcatggagccacccggagaaactctccagaaaggcagccgcgttctccgccttccgggtaggccggtactcatacagcacaacgggggacttcgcgtccccactggtgcggtacagccacatatagcacttgctccgggctgcccggccctccagtttcagcacctgcagcgtggtttcatccgcgtggagcacctgtcgttggaggagccgcctgtgcagttcctcatataccggtttcagccagtcctccgccacccgcagcacccagttgctcatggtctgccggctcaactgcacgcctgcccggttccactcctgttcctgccggtacaacggtgcgtacatcacaaatttctgcaccatgatatgggcgaccgcctccgccgaggcatagctgccgggagtcagggcagggagcctttccgccttgcggatcggcgtctctgtcccttcctccttgcatttggggcaggcgtaggtgaaataaatgttttcccggatcatcacctgggccgggatcatcaccaatgtgcgccggacgtcccttccaatctccatcttggctgtgccgcacacagggcagtctggttccttctctggaatccggtgttccaccacctcaaccggtacattgtccggcaggacctcctccggcctggaagaacgccgggtatgggcggccacctccgtctctttggctctccgcctggacaaccaggcttccgtctcgtcaaacatgaggctcaactggggcctatcagttcttcttccagccgctccgaggacactccgtagagtttcttcctgttcaggcgcacttgctccagaagccagtccaatttctggttcagctcgtctctttccgctttcagagacgcatattccgcccgtgaaatggttaccatctccggggtgcttgtcccatgatttctttcatttttcatgggtaaattatactatatttgaactggaaagtccagtatttccagggttttcagctattctaccgcctaaatgatacgcaggccgtccaccggacggtgggcctttagctgctccaccttcagcccctccatcagccagcggtattgctgcggcgtcaattgccgtacctcgttttccgttcgcggccattggtatgcaccctgttccaaccgcttatacaacaggataaatccatcccgctcccaatagaggcccttgatgcggtcccgctgtctgccgctcaggcaacggcgagagctctacaaaggctgccggtggctgcggtgctgaaactgcgggcacaagttctgtggctgccgatgaaaggatttccttttcccggcggtagtacgtctttgccgaaatattgtgttccgcacaccatccccttacgctcatgccgctgctgcggcagtctatgacctgtgtcttccattgttccagctttgcctgccgtttcaattcacacgcgcccatcttccccgccaccttctaaaatgagaattctcgagaagtctttagacttctcgagaattagtatctcatatcctcttcaactttttaatccgcccccagctttgacgcttacgccaaatcgaagatacagtgcggaattcaaagtaaaggtaatcgaaatcatgcgggcggaaggcctgaaccacagtgaagcaggccggcggtttgggattgagtctcatacactgcttcagatatgggagtggatttacttggcggaagggccggaaggtttctctgttgaacgacgagggcacagcggatcgggccgtcctctgaaacgggtaagccaggaccgtgagaaagagttgctggctcaagtacagcgattagaggcagaaaatcgatacctaaaaaattgcgggcctcggttttggaagacgagcagcgccagcgcaaaaagcgcgggtgattcaagaactgaggccagaaatccctttgaagatgctgctgtccgttgctcacctgtcaaggcccacattttatgatgagataaagcggatgaagaaggggaacaagtgcgcatccgtaaaaagagaaatccaagcaatttttaaagaacaccggggcagatacggttacaggcgaatcacagcggagctggaaaacaggaagattcattgtaatcacaaggtagtctccagactgatgaaggagcttgggttggtgtgccgagttcggatgaagaaatatcgttcttacaagggcgagatgggacaaattgcgccaaatctgttggagagaaactttgaggcagaacagccaaacgaaaaaatggtaacagacgtcacagaatttcatcttttcgggcaaaaactctacttatccatcctgcttgatctgtaagccgggacattgtaagctacacgatttcagatcgtccggacctaaagatggtgacctccatgctggagaaagcgtttcataaaattccggatgggacaaatctgattcttcactcggaccaaggctggcattaccagcatagaaagtatcgggacatgctgaaaggcaaggacattcggcaaagcatgagccgaaaggggaattgcctggataatgctgtcgtggaaaatttctttgggctcctcaaatcggagctgctttatctgcaaaagtttgcatccatagagcagtttaaaacagaactggtctcctatcttgaatactacaacaaccgaagaatcaaattgagcccgggcggtctgcctccagccgttcatagatgtaaaacccttggcgctgcttgagtcagtcgtagttgtccaatattttgggtgcagttcaacttttgaaaaaaggaaattgtaaagtctttgataactccgatcaaatagcgtggctattttatagaagttgcagtatgttgtgttgctgataggaggcgatcgatatgtcaaagaaacgagccaacggcgaggggaacatccgcaaacgcaagaacggccgctgggagggacgatacactgccgggtacgatccaaagaccggcaaacgcatcaacaaaaatgtgttgggtaagacgcaggcggaggttcgggaaaaaccgaaaacagccatggcggagtgtcaggggctggacgtcagcagagaagccgatgaacacacagtagccacctggctgaaaatgtggtatgaactctatgccaagcccaacgtccgcacagccaccgccaaccgctaccagctcatcatcgatacctacaccgtccccgcatcgggaatatcaaattgaagaagatgaccacccggcatctgcagaagctctacaaggagttattagaaaacggtagaatccatgttggaaagaaccagagcaaagggctcagcaccaccacggtccgcagcgtccacctgatgctccacgccgctctggaccgggcagtaaaagaacggctcattccccgaaacccctgcgagaactgcatcgtcccaaagccccgaaaactggacatgaaagtcttatctccagagcagatggggggctattttggaagccgcacagcggcgagatctgctctctatgttttatctggaactggtcagcggattgcggaagggagaactggtggccctgcggtgggacgacctggatgtccaaagcaaaactatctcggtaagcagacagtatgtccgaaacccggatggaagtctggagctcacaaggcccaaaaccgaaaactcagtacgtctggtgtctatcccacaggcagcggtggacctgctgctccaggagcatgaccaccatccggataatccatacatgttcccctctccattagccggagagatgtatcacccggacagcgtggtaaacctccacaaaaagatcctgaaggacgccggattggaacatctcagattccacgatctccggcacaccttcgccaccacagctctccagaatggcgtggacgtgaaaacagtgtcctccatgctagggcactttgacgccggtttcaccctccgcacctacacccacgcaacaaggcaaaagcaggatgaggcaacccagaccatgggcagcttcatggaacaggtcatgtaagacagagagaaaaatgccggacgggaaggcaaatcttcccgtccggcactcttgtgtccgttatttcctttccgcgtgtgggtcacggtgtgggtcaacccgctgccccacattttgacccacacgaaaaagtccacattcgcaacaaaaaaacacctgaaatccgaagatttcaggtatttgttggagctgctgggcggattcgaaccgccgacctcatccttaccaaggatgcgctctacctactgagctacagcagcataaaatggcgacccggaacgggctcgaaccgtcgacctctagcgtgacaggctagcgttctaaccaactgaactaccgggccattttgtaggctcgtcctattataagcaaatacatcctgccttctaaagattccaatggcaggagcagaagaattcgaaccctcggcatgcggttttgggatggctacaaagagcaacgttcctctactgccccaaacacttaccaatccatagcagttcgctcttcacaattctgacgttttcttgatgctgtcatcctttgggacaacgcatccgccgcacagaacaataaggattatactttacgccgcagcttttgtcaatcctttttttgatttttgagacatttttttaatgtctccattatccagcagacagacagctgccttgaggcacctttgcagcaggtgtgttttgtcgcttcacaattctactgattttggagtcccaagggaagctgtgttttcgccgtttccctttttcttttgccaacaaaaattttacactaaccagaccaaatctctgaaatttccagcgccaaggatgaccgtagcgcacagacatggaaaaagccgcccctcaaaaaccaaggcgcataaaacaatggaaagccctttcctcggggaacttcaaacctatgagaaagagccatactggcgccctcgatggatgcctccttccggagatggccgatagcctgctgatctgcatggaaagtatggtgaaccaaggccagcgtctacaaagaggccacctgggtcaagaagctgaaaaacacgctgaatatccagttccaccagtccattgcagagcacttctcctgggctggtctggaaaattctgaaataccgggagagctacagccatatgaatcacgctttggacaagagggatgccaccagcgcggatatcctgctagatattattgtgaagctctggagttgctgcagtccattttcttttcacccgcacctcggccgcaagagaaaacaccgccaggaacggtgttttttctgtcactcttcaaattgaaaaaacgctctgccatcatgtcagagaacggcaggtcccccgctggaccaggctgggcatcaaaatctggtgcacataaccctgggtccccttttcgatcttgtccagcagcatatccaccgcctggacggccatttcctttttcggctgctcaatggtggtaaggtcgatgcgcggcagcgcagtggaggggatgttgtcaaatccgatgagggacagatcccccgggatgcggatatggagctcgtcagccgccttcaggatgcccagtgcgttggagtccgtagaggcaaagatcgctgtatagtcgatgggctttgcaaacagctccttgaccatctgatatccattctcgatggaggaccgggcaaagtcgctgtgatggagcctgggttccagcccgaattgccggcaggcccgcagatagccctccgcccggagctgatgggtagtggagttccggcaaccgaagtacaggatctcccggtgtcccagtccgtagagatactccacccccagataggcgcctcggctgttgtccacagatacgtagctctggggctgatcccgcagattctcgctgagaaacaccgcagggatctgctccagcagcggggcgatcttctcataggtggccggggactgggggacgatcaaaatcccgtccacccggcggcccagcagcagtttgaccaccatctcctcctgtttcaaatccggctctgagttgcacagcataatgttgtagcccctggcccgggcgctcatctccacataataggccagctgggacatgaactcattttcaatggccggcaccaccagtcccagcagatacgtctttttcatcaccatggagcgggccacgtagttccccgtgtaccccatctcgtcgcacaggcggacaatccgctcccgcgtgctctttccgatctggttactccccgacagagcccgggataccgttgcataagagacaccggcggccttggccacatccttcagtgtcacgttcttcatgatctctgtcctttccatcggtccatgcctgagccggttccattgcgtaaacgttttcattttgacgccgttaaaatcaaacaaatcgtcaatttcacttttcttattgaacagcatatagaattatatcaaacttgtcaatatctccgaaaaaattatcattatagtgatttctccaaatctgccgaagattctttggcgggcgccgacttgacaaatgacagacggatatcctaaaataaaatcaagaaaaccgcaaacgtttacattcttcagctgtccgtttacagaagctctcctgcccactgtgaatggcggcctgaaacataggggaggtcttttgatgtctgtatccaatcacggcggtgcccagctggcagaggccgtccggcatgcctatgccgcagggcaggacgactatcatctggagcccatggtgctgactgagcgcggcgttcccgtcggccgcatccgggatcacgacgcggtggtgttctgctgccgccggggtgagcgggagatcgagctgacggaactgttcacggcggacgacttccgggccgtggagcgccggaagctgaaggatctgtacttcgctatcctgacactgtatcacgacaagttcaagcatctgcccgtcgcctttgcgccggaacacgtggtaaaacctttggcccaggtcctctccgaggccggaaaaacccagttccactgcgcggagtccgagaagttcgcccatgtgacctttttcttcaacggcggggaaaacacctccttccccggtgaagaggatgtgtgcgtcccctctcccaaaggcatcgactttgaccagaagccggagctctccctgccggaggtggcccggactgtggcgggcgccctggggaaatacgacttcatcgtcaccaacttcgccaacggtgatgtcatcggccacacccagaacaccgccgccaagctggatgcctgcggttacgtcagccgggccctggagcaggtggtggatgctgccctggcccaggactacgtggtggccatcactgcggaccacggcaatatcgaaaagctgtacaccgttgccgggaagccggacggctcccacaccaccaatctggtgccctttattctgatagactcccgtcaggaggaccccatctccctgcgggacggtgccctctgcgacgtggctcccacaatattagacgtcatgggccttcctcagcccctggagatgaccggccgctccctggcggagggacacgcctggagccgggggcggaggatgctcctcatcatctgcgacggctggggcctgggcgccggcgatgagggcgacgccatccacctggcccacaccccctactgggacgcccttttggaaaatcgctcctggtgccgcctgcaggcctcccgtgaatttgtgggcctgggggccggcaaggccggcaactccgaggccggacactccaatctgggggccggccggtgcgtcatgcaggacgacgtgcggctggacgcggcggtgcaggacggctccttcgcccgcaatccggtctttctggaggccatcgagcatgccagacggaaccatgcctccctgcatctgctggcctacctcacccataagtcctcccacgggtgcatcgactatcccctggccatctgtgagatggccaagaagcagggcctggaggaggtctacttccacatcatcttcgacggccgctccaccgaacccggctccgccccgcgctgctggcggagctggacagccgcctggaccagatcgggctggggcggatcgtggacggcgttggccggggcgtggtcctggaccgggacaagaattacgacaaggtaaagcgggcatacgatgccctgacagacggcctgggcgcctggtattcatgagcgccgacgctcggcccgcgcgggatgcgctcctcattccgcgcgggccctgtatttgtgatacagccgccaagggcgtgctgcgagattgtctgcacattggaaaagaggtgcgctatgaaaaccgtgttgggctatctgcgcccccatgccgggcgggtcgccgccggtgccgccatcaaattcaccgcagcggtcctggagctgatcctccccctcctgctggcagaagtcatcgacgagctggtgcccgccggcgacactgccgccatctggcggaccggcggctggatgtcgctgctggctcttggggcggtgggctgcaatattaccgccaaccggatggccgcctgggtctccatggagatgacccgggtactgcgccaggatctctaccgccggatccagggactctcctgcacccaggcagaccaattctcaccctcctccctggtgtcccgcctcaccaatgacacctacaatgtccaccagatgtttgacaaggtccagcggggcggcatccgggcccccatgctggtgttgggcggattgatactgacctttctgctggagccctctctggcgctggtgcagctggcggtgagccttctcacctttctcaccattacgctggtgacccggcgggggatcccccactacaccagagctcaggcggctgtggacacggtggtgcgcatcctacgggagaacgccgccggggtgcgggtggtaaaggccctcgcctgtcaggtcagggagcgggatcgctttgacacagccaaccaggcccagcggcaggcagaggcgcaggccgggcaggtcatggcgctggcaaaccccataaccgatctgctgctgaacgccgggctcatcctggtagtcctggtgggggccctgcgggtcaacgcgggactgatgcccccggggcagatcgtcgcctttatgacctacttcactctgatccaaagcgccacactggggctttccaaggtgttcgtgaaggtcagcaagggcgccgcatccgcccgccggatccaggaggtcctgctggccccggagcagcagcggcaaacagctcccctgcctgctggcggcggttttctgggcatggaccgcgtcacattctcctatcagggtgccaagccggatgtggaggaggcgtccttcctcctgcgccaaggcgggatgctgggaatcctggggcccaccggcagcggcaagagcacactgaccgccctgctgctgcggctgtatgacgcagaccggggcgtggtctgggtgggcggcatggatgtaaaagcccaggatcgccgggcactccagagccgcttcggcgtggtctttcaaagcgacgacctgatccgcggcaccgtctatgaaaacatctccttcctgcgaaatctcccacggccagcggtgggagccgccgcccggacggcccaggcgtggccctttatctcccagctgcctcagggtctggacaccccgctggacctgggcggcgccaacctctccggcggccagcgccagcggctgctgatcgcccgggccctggcggaccggccggagatcctgatactggacaatgccgacagcgccctggattactccacagccgccgcgctgcggcaggcgctgcggcgggatttcccctgcactaccctggtgataatctccgagcgggtgtccgccgtgcgtgaagcggactgcattctggtcctggaaaacggccgcatcgacgcccagggctgccatgacgcgctgatggcctcctgccggcgctatcagcgcatggccaagctccagatgggaggtgatgtcggatgaaacgacatctgtttcgccggatgggccggttcctgcggccccaggcgccgtccctagcaggggctgcggcgctggccgctctgtccggtctgctggcgctgctggtgcctctcgtggcgggctgggcggtggaggccatcgggactgggccgggggctgcggacctgaccgcggtgctgcggtactgtgccgcaggtctcggagccgctgtcctgtccgctgtttgcagctacggcgcctccgccgccctggtgcgggtggggcagaccgtatcctacacattgcggaaggcagcttttcagcaaatcactcagctaccggtccggtattttgacacccacccggcgggggatctgatcagccgggtctgctatgatgtggacacggtcaacgccgccctgtccactgatctgctccagatcggcaccagcctgctgacggtcattggctcctttgtgatgctgctgatgctctcccccctgctctccggcgtgtttttcctgaccgtgccgctctccgtcctgctgacgcggctccagatgaagcatatccatcccctgttccgccgccgctcccaggagctgggggccttgaatagctttgcggaggagcgggtcagctgccagcgggccattcgggtctacggcgtcgaggcggcagatcttcggcagttcgccgagaaaaacgacgccgcctccgagacgtactacaaggccgactgcgccagcacggccctggggccctccgtcaacttcatcaacaacctctccctggcggcggtcagtgtctttggtgccctgctgtacttaggcggcggactgtccctgggggcgctgtcctcctttgtgctgtactcccgcaaattctccggtcctatccgggagacggcggaactcctcagcgacctgcaggcctccgtggccgcggcggagcgggttctggatctgctggaccagccggcagaggatggcgacttgccgggcgcccgggagccatgcaagctctccggcgccatctccttccgccatgtggacttcggctatgaccccgcccacccggtgctgcgggacttcagcgcggacatccccgccggcagcatggtggccgtggtggggcccaccggggccggcaagaccaccctggtctccctcctgctgcgattctatacaccccagagcggcacgatcaccattgacggactgcccctccagcagtacacccgggacggcctccggcgtcgcttggccatcgtcttgcaggacggctggctgtgcggcggcaccatcgcggaaaacatcgcctacggcgtgccgggcgctacccgcgcccagatcgaggccgccgccaaggcagcctgtatccattcctttctctcctccctgccggatggatatgataccgcactcactgacagcggcgccggcctctccaagggccagcggcagctgctggcccttgcccgctgcttcctctccaatgcggacatcgtgatcttggacgaggccacctcggacgtggacccggagaccgaggagcagatcagcgccgccctggagcggctgcggagggggcgcacctgtttcctcatcgcccaccgtctggccacagtgcgcacggcggaccgcatcctggtactgcaggacggccggatcgccgagcagggcactcaccagcagctgctggatgccggcggcatctatcgggtcctatacgatgcccagttctcctgacagcccccggatttcatgacaacacggagaggcgccccggccattcagccggggcgcctctccgcaagaaagagaaaaaagtaaagtgagcaaattaaatgagtggttatgcgccgggggcgggggccagctctggattgatctggtccagccaagtcaccaggtccatcagtgttccgataaccttgtccggctgtgccgcatccgcggccacgtgcacatccttctgctccgacaggaaggaacggatctgcacggccttggcaaagcccacctgcttggggccgatgatgtccctggagaccgtgtcgcccacatagacgcacatttccggctttgcctgcatttgccgcagggcgatccggaagatctccggatggggtttgcgataaccggtgacgctggagaccgttacatcctccataaagccgcggatgccgtagtcctccagcacgcggaacacattgtacagcgaggcgttgttggagataacgcccaggtggtagccccggctcttcagggcctgcagcatctctgccgcgccgtcgcggagctcccggtggtagaaggtgacctcccacaggttggccagctcctcggtgatgggcagcagcttttcccggtcaaaggcaaagtcccgaagataccagtccggccaaatctcctccggctttttctccagcatattcccctcgctccactgcttataggcctttacgccgtccgtgatccgcttccagaacacatcgtccgggcagccgggctccaggccgttggcccgcaggacctccagcagcctgcggcaggtcgcccgctgggtgtcctcgttgtaccaaatatcctccagagttccgcccatatcaaataaaacggttgtcagcatcaggaatcctcatcctttccgtgtgtattccgccggcggtggcagccggcatcctctccgtcctcaaacaacagcatggcatcctcctggggagaccgccggggccgctcttcagcagccggggcagcaggatgcgctttgggggcggcatcagccttggtcccggccgcctcccgcatctcctcctgcagagtcttctgcacaggcagaggatgggtctttctcagcttgagatagaccggccaagccaccgcgtttccgatcagggccggtgccacaccatacagggtaatcagctgcaccatggttgcccgctggtctgtatccagcatccaggctgcgaagtagaacatcaccagaaccaccgccagccccacaaacccgaacagcgccacccgcttgtcccgcagaaggaacagcaggctgccgattgccgtccccgccaatgcgatgatcagcgtgtgcacggcgttggtggctgcagtgctgggcagcgtaagctgccggtacagcggctctgccagcagggtatacagaaccccgtagatgcagaggtccagcagggtggcgaaaaagcctgcaatggcaatggggctcttccgccggtgattcttgtcaatgaatagattcatgcgcatatctccttatctgagagggccggaatggagagccggcggacggattcccgtccgccggccgtgtgaagcagccaggatcgccgaagtgctgttatccgagcatctgccagaagtcacggacggtcatgaactccgtgtagatggaattgggatcgaacggggaaacgttcatctcctcataggggacagagccctcagcgggttcaatgtcgtcccggacaggccagccgcccagggtgttgaagggctcgtagccgctggtatcgccatcaatgccgcccatcatgaagcggatcagcagtttggcggcagcgggatgctcacagccttccaccacgtacagggtgttgatggcgggtatgccggtggtgggatacaggttcacgggagccaggacccagccgttatcctcgttcttgcgcagcttggaggaggcgcagaaaccaatggggggatcggactggccgggggtgccgacagcctcggcaacctcgtcagaagcggaggtgaagatcggctcattctcacgcaggcgcttcaggaactcgtagccggcgttggcgcagccctcagagagcaccagctcctcgccatacagttcctcataggcggcagccagctgatccggggtatcacccacgcagaagccggtaatccaggagccccagcccacattgttcaggggatcctgcatcaggatcttgcccttccattggggctcggtcacctgccagatgttggtgacaggggaaccgtcaggataagcctcagcattgtagaacagctgggtcagctcaatgtacagaggggtttgcgtctctgtcaggctgggatcaatatgggcgaggatgtcggcaggctgatatatgtaaaaaatcttgttttgcacatactcattgtacagggagccgtcctcgtccttgatatggaccacatccgccacatactggccggcctcgtgctcacgggtgaccttgtccagcaggtcgttggtagagatatcaaagggcgtgcaggtgatttcggggtacttgtccatgaaggcctccgccaccttggtgcagcgggaggagatggagtacagggtgacctcgccgccctcggcgatggcctgctcatagagctcctcatccgtctcgtccgtggcggtgatgttggcggtttcctcccaggaggtggcgccggcatcctccgcctcatcatccgtgccgccgcagccggtcacagtaaacagcatgacagcagccaacagggcgctcaatagtttcttgtgcttcaacatggttcttttcctcctttaatcattcttcctcaaatcgctctcttttatcgcaacggctgacgccgcaggatactccgggatcgctcggatgatggaaacgcgcattagcgggagtacttgatcaggcgtttggtagaggcgtcgaacacattgaccttcttgggcgggtaggagagatagaccgtctcatcgccggcgtaatgggtggagcccagctcctttacagtaatcagcttctcaccgacccggacggagaccagggtctcggaaccggcgggcattccggcgtatacacgggcctccacctgcgcggcgtcggtcttctcacgggaaatggtgatctgctccgggcggatgcccagaaccagcttcaggtcgccggaggcgggcgcttcaggcgtcatgtcctcccgggagaactccaggcggcccatgacaccgtcaaccgacagcccggacgcgccggcggtgcccgaggcctccacgaagttgatgctggggttgccgatgaagtccgccgtatagagatcgcaggggttgtcgtacagctccagaggcttatccacctggaccagctcgccctcacggaacagggcgatcttggtggacatggtcagcgcctccacctggtcgtgggtgacgtagatgatggtgctgccggtgtcgtggtgcaggcgcttcagctcggaccgcatatccacgcggagcttggcgtccaggttggacaggggctcgtcaagcaggagcagccggggctctgacacgatggcgcgggcgatggccacacgctgctgctggccgccggagagctcggtgggataccgcttggcgtactggccgatctgcatccgttccagggcgctggcaaccattttttcgatctccgcggaggggatctttttgatcttcaggccgaaggacacgttctcaaagacagtcatgtggggccacagcgcgtaggactggaacaccaggttcaggttccgctgggacgggggcgcgtagtacgcctccgccgcgttgacgatctccttgccgtccatgtagatgaagccgttctggggcttttccaggccggacaccacccgcagcgttgtggtcttgccgcagccggaggggcccagcagcgtcatgaagtcgccgtcctcgatggtcaggttcagatctttcagaacgtggttcttgccatagaatttatcgatatgttttaattcaatcttgctcatgttcgtcgtctcctctcagttctctgtccgcgtcagccggccatgctcttggccaggtccgccttgccggagagattcgctatcgcatacaccaggaacacaatagagaacatcacaatcgccacgcagtcagatgcctgcggcgagttgccgttctggtaccggaacgccaggtacggcagcgtggaggtggtgggggtcatgatcaggatgatcagatccagctccttcatgatggaaacgaagatcagcatgaagccggagatgaagccgcctttggacagggggaacacaatcttcacgaaccggcggaagaatccggcgccctcgatggtggccgcctcttccagctcaccgctgatctgcagcatgttggaggtgccggcccgcgccgcgaagggcagatgcttcaccacggacaccagcgtcagcagagcgaaggtgccgtacagggcgggcaccagggtcacgccgaagatctgctggggctgggagaacatggacagatagatgccgccgaacgccacggacgggatcagataggggatgaacaccagctgttccaccagcttgccgtggagcctgccgcggcccttggcggtgatgtagccaagcagctggccgaagatggtgccgaacacgccgttcacgagagtcaggcgcagggagttgaacagggagttgatgaactcgtcattcttgaagatgcccggcagcccctccataatctggggattggattcgccaatccagtagtggagggtaaagttgtccagggagtagataccttccttgagcatgaagctctccatgaccaagatgacgattggcatgatgatgcccactgcgaagaacacgaacagcgccgcagtgataaccggcctgcctaccttcccaaggccgatcagggtggatcggccgcccttgccgccgatggtggcgtaggacttgcgggagccgatcagcttctggttgacgaacacggcgatggaggcaataataatcatcaggatcgccatggcaaatccggtctgcgtatcccgggagttgatattcatgtacagctggctggacagggtgtagtactgcaccggagagcccagatagttgatggttccgaaggtgccgatggccttggagaaagtcaggatcacggccgacaggatggccggcagcaccaaaggcagagtgatcttccgcaggatcatggccttgcccgcgccctggatctcacccatctcctccagctcggagttgatggagttcagtgctgaggataccagcaggtatgtataggcgtaataatgaagggtcagcacgatgatgatggcgacagggccataggccagccactccggcacatccagccccagggaggccatgaagccgggcgcgccgcccaacctcgctgtcttgaacatggacagccacgcctgggatttgcaccaggaggggatcatgtaggggataatcaccgccagggagaaaaacttcttgaagggcagatccgaccggaccatcagccaggccagaatggaacccagcaggatggcgcacacggacacgcagacgccgatgaccagggagttgatcaacggcttgatcagcatggtccaggacagctcactggccagcagccgctgccagtagtacagggtaaagtcgccggccttgccgccgcccacagcccggatgtcccgctgggccagctcaaaggtggtggcgatcatgtccagcagcggcaggacgatcagatagaccagcagaacgacggcgatcagtacgatgatgttgtagggatttgtcaccactgccttgatctgattcttcagccgccggctttttgaatacgtttgctcttgcggtttcatcttcctcttgcaccctctctcctcagttcctcttgttgtttgtgttaaatatcgcaaacgttttcgtttctatgcgatttcaaatttaacattcgttcatacttttgtcaagaactataccgcatatttaataaagtatccaataaaattattctaattttggttatttcgttgtcttgcaaaattcaaatccgaacggctcacacaaacgttttccgggatttgaaaaaaatgatgcgttcacttcagcggcggcagcaactccagcaattccgggaacgtatcgatcactgcatccggccgcgtctcctccgtgaactccacaggatgcttcttctccggagaccggaagatgatgttgcagccgattcccgcagccttggcccctggaatatctcgcttgatgttgtccgccacggagacgcagtctgccagatccacccccagttcccgggctgcaatgtggtaaatctccgcgccaggcttgcgcagatggcacacggaggagagcaccacactgccaaaatacggggccagccgatcctcctccagccagtcgggcacctcgtgctcgccaatcaggttggacacaatgcccagcttgtatccccgctcgtgcaaggttcggatcacttctgccccgccgtccaccaccacacgccggcctttggactggcggtactcaaaggacagctcatggcagacctgggcaatgcgcttctggtcatagtccggcagcagccaccggcaccagagctcccggtcgccagcctccttgttctctcccagggcccagcggcgataggactcgtagcggtcttctaccaactgatagaagtcctccacctgcagcggtgcccccgccagctccgtcatcttcctgcgggcatggcgcatatagggctcatcctccagcgcaatccgaagggtgccgcccaagtcgaacaggacggccctgtaccttttttcgttcatccttcctccttatccgcagacaggcagatgctctctggatccgctgcccactcgtcttatgcaccgaatgcaaacgttttcgattttctgtctttattctatggtagattacttttctctgtcaaggggaggaaccgccaaagacactcccctgtttttgccattttgaccaaaagtccagaaatcgcagttttatattgacttttctgacaaaactctatatatttcaatgcagaagtgtacttctctttcttgcgggcggagttgcgtcgcagaatcgaaaacgtttgcattttcgaggactttttggtggaaaaaccggcttttgtctgccctgttccaaggcgctgcccccctcccgcagtttgagcgtgacagtctgaatcatggaaagaaggcattttatggacggatacctgtttgacccccacactcacacggcggaaaccagcaagtgcggccacctgccggcggcggaggtggtggaccgctatgtgcgccatggcttctccggactggttgtgacggaccatctccacccggagtacctctcccggattgacacagaccacgattggaataaggtcatagaccactatctctccggctaccgcgcctccaaacagcggggcgacgaggtgggcttccaagtgctgctcggcgcggaactgcgatttcccgaaaatgacaacgactacctggtgtacggcattgatgaggcgtggctgcgatccaacccctacgtttgctgcatgagcgcccgggagttcttccagaaattccatgaccaggtgcttattatccacgcccacccctatcgggacggcaacactacggtgtttgaggacgcgattcacggtacggagatcatcaacggcaatccccggcacgacaactacaatgaccgggctctagagctggcccgccgccatccagaatactaccgcctggcgggatccgacacccatcagagtggggacgaggcccgggccggcgtgatcctgccagagaggcccgccgactcctttgcctacaagaccttgattgggcagcaccgtttccacctctggagcccggagttccagtcctttgtggacacggatgaggaaatgcggaaggagaaacagaaatgagccagtttgactctctgatcatcggcgaggtggcacaggacaccaatgtggactatgacggcaccaccgtccatgccgtgggcggcgccgtgtactactccggcttcgccgccgccaacaccggccacaagaccgcggtgctccccaaggcggacacggcccaggtggacctggccgccgccttcgccccagccccaaatgtgaccgtctatcccctgcacagcaggacctcctttgtcacaaaaaacgtctaccacaccccggaccgggagcggcgcacctccaccgtggacagcgtcatcgaaccataccgcaccgaggaggtgccggatatcgatgcggcgatctggcatctggcgggcctggcagcgggcgacattcccaacgagatgatcccctttgccgcccggcacgccatggtggccatcgacgtgcaaaccatgctgcgctgggtggagaacggcggcatggtctatcacgactgggcagagaaaaaggagctgctgccgtatgtccgatttctcaagaccgacgcggcggaggcggagattctgacaggtctcaccgaccgggctgaggccgccagacagctttaccagtggggcgccaaggagattctcatcacccataacacggaggtgctggtctacgatggtcgggagatctacacatgccccatccgggccagaaacctctccggccggaccgggcggggcgacaccacctttgccggctacatcaatgagcggctgactgctgacatccccaccgccctccgcttcgccaccgccttagtgtccctgaagatggagacccccggccccttcaccggcacccgggcggatgtagatgcctatctgaaggaattctactgagcgccatttccgtatccatctcccgaaatcaccaagacggctgccaacccggcagccgtcttttcagctctgctccgaagaaggagcaaccaacttctgcaaatgtgactatcttcaccccagatgataccatgaagttcaaagccgaggctctccgcacctggggaaacaggacacgcatctaccagaatgcgggatgtgcctctcaacgaggcctcggtggacgccatcctggatctgagagcggagtggtacttcgtagaagacgcgtcgatcatcgctgacgagcacgaaggctatacccgaacggtactaccgcatcctgaaggcggctgagctgaagcagcgggggctccatactctgcttcgccgccaatctggttaacagcatcaaacaaccggatgggacgctcggctccctttccccccggcaggtggccgtcctccttagacaatccgcctcggagattacggagctctactatgtgaaaaaggacgcctccgcttgacagggatcacgacaggattcgatctctgaggtatgcgaaaaaagaactcccctggccagcaggcaactggccaggggagcaaaattttaaagctaaaatgatgctgtagcagacagaaacaagactttcatgggtcggggaaatcaatatgcagccgcgcatttatggagccgcatattaaagggcgcaaaatcaaagggcgtcgggtggcaccccggcgccctttggcttttggcagacattgcgtgaaactgcagttctcaaacctcgcgagaggggagcggccgcatctgcctgttctgggtggtttgtattcaggctatgcggctgaggatccgtgagaggcctcgcctcaaaagacgccctgctccatcatggcctcagccacccgcttgaagccggcgatgttggcgcccgccaccaggttgtagcccaggccgtactcctccgcagcctccacgctcatctggtagatggtgttcatgatccggtgcagctgcgcgtccacctcttccgccgtccacaccagccgctcgctgttctgcgccatctccagtgcgctggtggccacgccgcctgcgttcaccgccttgctgggcgccacgatcatcccgggctgctccatcaagaaccgcagcgcgtcgttggtggtgggcatgttcgccacctcaatgtagtacttcacgccgttggccgcgatctgcttcgcctgctccatgtgcacgtcgttctgcatggccgagggcatcaccacatccgccttcaccccccaaggcttctcaccggggaagaactccacgccgaacttctccgcgtagtcctgtacccggttgcggccgctggagcgcatctccaccagatacgcaatcttctcctccgtggctacgccgtccggatcatagatatatccgtccgggccggacaatgtcaccaccttggcccccagctgcgttgccttcctgcagatgccccaggtcacgttgccgaagcccgcgcaggcgatggtcttgcccgcgatccgctccccctcgtgctccagcacgttctggagatagtataccgcgccgtagcccgtggcctccggccggatcaggctgccgccgtaagagaaccccttgcccgtcagcacaccgttctcccaggcccccttcagccgccggtactcgccgaagagatacccgatctcccggccgcccacgcccatgtccccggcaggcacgtccacgtccggcccgatgtaccggtacagcgcctgcatgtacgcctggcagaaccgcatgatctccgcgtccgacttccccgccgggtcgaagtccgcgccgcccttgccgccgccgatgggcagacccgtcagagagttcttgaagatctgctcaaagcccaggaatttgatgatgccgggatatacgttggcctggaaccgcaggccgcccttgtagggccccagcgcgccgttgaactggcaccggtagccgatgttcgtgtgccactgaccctgatcgtcctcccaggagacccggaaggtgaacatccgctccggctccaccatccggttcagcaggtccaccttctcatactccgggtgcttctcgatcaccggctccagagaggagaacacctcctccaccgtctgcacgaattccggctcgttgccgtgcttcttcttcacgttctcgatcacgctggtgagatatgtgttcatggctgttttaatcctcctttattttatcaagaacagttctcaaccttgcgaattaggaaaacggacaatccttcctttcgaaaatgtaaggcgtatatttccccaagcttctgtgggctcaaaggccctttacaaaagcctccattcgccgcaacccctcctggatgcttttctcgctggtggcgtaagacaggcggataaatccctcgccgccttggccaaagcctgtgccgggcacgacaaccacatgttgctcctgcagcagccgcatcgcaaactcctgggatttcagtccagtcccggaaatattggcaaatgcatagaatgcgccctttggccacagacagctaatcttttcaatattattgagtcccttgacaatcagctcccggcgacggcgatactggcacttcatttcttccacgcagtcctggtttcctgtaagcgccgccaccccgccccactgaacgccttcattcacagaagaaagtacgttttccagaagctttgtcataacagtcgtgacttctaaaggcgcagcgctccaagctaaacgaaagcctgtcatagcatatttcttagaaaagccgtctaccactactgtacgctctttcatccccggaaaactggcaatactggtataaggctccccatcccaaatcagttcgcgataaatctcgtctgtaagaacatacaggtttcgctcttttgccagatccgaaatttggcgcaggttttccgcgctggctacaccgccggttggattggaaggcgaattgatcaagataactttggtctttggcgtaatcgcattccgcaggtcgtcaatctcgtacatgaatccgttttcttccttgactttcacaggaatggggacggcacctacctgcatcatcaggcctttgtaattggcccacccggggtctggcagcaacacctcatctccgatatccaacatggcggtgcaggcaagattcagcagactgattgcgccggccccaatcaggatctcactcggctgataatccagcccccgcgcctgataagtcgcagccacggccttccgcaaagcaggaatgccggtattgggcgtatagtgggtttccccgcgccgaaaggaggctaccgtcgcatcaacgacatgctgcggggccgtaaagtccggttcccccaacgcgaagctgatgacatccttcattcctgcttgcatagcgaacatttctcgaattagagagccaggaatctgcttgcttttcttcgaaactattgacatatctatattttcctttctgtcctttcgagttccattattcggtctaggcatatccatgcgcatgttgtcctcggtatacacaggagagatgctcccgacagcccgacgcaccaggacgacattccagaaggctctcctcacatccacccagcgggcgggtagagcactgtcccgccagcgtccaaatggcgtctacatctctgtccgccccccatacttgaatgagagaaccgccttccgctccttgaatgccgccttttccaatcaggactgatttcacaggcgccagcatagagatggcatccaactccgtaatcacttctccagctaatggaagcagtccgcaggccatcccatgggaggctgagacatgttttctttgagacaacgctactgctgatgagatatttccggacgttagtttttctgtccctgctgctatgaggacccggattccttcggtctcaatggcactaagcgccgcgccatagctaccgcccccgggactccccgcaagaagagccgctccgccgctgcaatcaattaaattcgctccagtaaccaatacacattccggtccaaacttcaaaaaggcatctctctccaagccatccagggaccgtatgccctgccggctgagaagtaccgtatgtggattggagctctctttcaaattggccacagccccgcggcatgttacccggccgcacagcctcaggtgcgatcccgtcagaatggcgctgagacaggaggttgtggttccgcccttcaaaattaatgttccattttccagtgcggtctgaacttccggccgcctggaaattgcctcggcaatcagccactttgcggcattcacactcaaaaaaatctgaacacgtttcaaattttttacctcatgttgtcaaaaccctcagcaaaacttctgttgtcgaaatcatgtcttcaaacaggatatgttccttgcacccgtgaacttcctgcatacctaccccgatattgatagcagccagaccattttcaaccagccatgtgatgtcgctgccgccgagcgtctgttcaatgaccggtgtgatgccaatactgcgcatggcctcacaggtcttttcaataatgggtgcggtaaccggaatacaaaacgcattagagacccggttctcggttttgcagaattttgcgccccaggcctgacaaaccttttccacgtggccgcaaatattctgtacaatcgactggagctcctcctcctcgtaggagcgaacctccacatcaaaatccgctttctctgggacgatgttggtttgcccggggcagagcaaattggccacgttgacaacgctaatttccgacacacggccgcattcgatgccggaaatacactctgccacagctttcagagcatggatgcctttttcaggagaaacgcccgcatgtgcgctctttccttggatagaaaagtgaatcttcatatatgcagccgcctggttcaccaagtgccccacatcctcattgtctaaaacaatggcctctttgctgataattttgctgtagtcagcgtatttggagccgagaatgccgttttcctcacagatagtcagcagaaattcgatcggccgatgcggcaagcctttctcaacaatcgtctggacagcctccatagctgcagcaataccggctttatcatcactgcctagaattgtggttccatcgctgtatatgaccccatctctcaaaataggagaaatcccatagcccggggccacagtgtccatatgggcgcaaagaagcagaggagcgcctgtacctggtagaatcgcatggagattccacccgttggagccgaacatttccccaatctcctgtcgttcccaatggagtccaagagaagtcaattcttcctccatcatgatgcaaaattctcgctcttgataggtctcgctggcacaggtaacatattggagaaagcgttgcagcaaacgttctttgttcatactaacatcctctcattcattccgcaaaatgcgtctctttgtcattggcaaactgatcgtaacatgctataatatgttaaattgtccacgaaacctttctgctagtagtcacccgaacacccgcagatgtataacagctcaggaggggatgtgaaatggctcttaccgtcgccgatgtattaaagctgaagccctttgccaccggcaaggtaatcgcaggggaaaacggtgttacccgtaaagttgagcacgtcagcgtgatggaggtggatatcacagaatggttttcctcagagctggttcgaggtgcctctttggaaatttcctcaatgtatgccctggtcgaccatcctgagcggcaggtggaagccatccgacgcctgaacaagagcggagctgccgggcttgtcctctgttatgtgggaacagttttaaaggacgtctctcaggagctcattgatgtgtgcaacgaactggattttcctttgattgtgatgttttctctggtaggctacaaagagattatccgtgctgtatccgatgcgcttttggggcttgataatcaaaagctgcgagacgccattgacatctatgaatatgtgacggaactgctgatggagagcaggaacaactcctcgctggtcatgtctctggaacatatgctggaaaagcgcgtgatgtactttgatcaaaatgccgagcccatctacatctccggcttttccagagcgcgaatccagatggttgaacggtatatcaaaaatcatttctcagagtttttgctccaccattccagccagaccatttcctgcccgggatagatgagcagctctatctgcgcccaatctataataaggcattctattttggcactttggtaattgtagggtgcaggttttctgatttggataaaattgcgattgcccagatctgcaatgccttgagcatttccagtctaagccagatcagcatcagccagcagcaagaaaaactgcgcacagattttatacgggatctgttgaccatccatctatctgaagaggatatctttcgccgcagcacagcgattcactgcgacatctcccaggtagagggatgtattgtgctggatatctgcaatttcaagcagttgatcaaacaatacagcgaggagaaaatcgcttctttaaaatgtgacttttatgagttggtgcaaagcgaactcagcgctttaggggacaggagtatctgctgtgtactgagtgataaggtcgtaatcctccatattcagacgcccaagcaaacgattttgcaggtagcccgttctctccagcgggtccttaagcgcaaaaatattgaggtttccgccggaattggatatcgctgtaaaagtgtgcgggatatccaaaccagctacgaaaccgcaagactggcgctgcaaattgcaacctctggttttgcgccctctacctgtgtggacagcgaggagtttcccgcctatatgatgctgcttcagacttatcaggccgaccctggactggtcccgcagttgattgaccgtcttttagcccctgtccggcaatatgatcaaacccgaaacggtgccttggaagagaccttccgcgcacttttgcgctgcgacatgaattacaatctggttgccgaacagttgttttttcataaaaacaccgttcttcagcgcaagcaaaaaattgtatctctgtataaggaggatccttttcagttgccattgcgccgccagtttgaattcgcgtttattttagagggcttatacgtgcggaagggttcctctgattccggcgatatttaaagattcccggttgtcgatgcaactcattcgacaaccgggaatcttcttcacggcagatactcaggcgttttcttggcgcaggacttccgccatcggaacatggtcaaactcaaaatcatagtagcgggggttcataacggagaatggctttcctgaattgtattgctcccgggcgggcacgcctacgatgctgacaaagtcgccaacttcaattaccgtgttggtcaacggatggcaggtctttgtatccacgcattgaacgatatcagggctggtaatccatggcttgccgttcttccacatcacatgatactcattctcgaaccacagcttataggtattgccagcaaactcgtccacaccttccagctccagcgtgccatagtacaggccgtcgatggtctttccctcttttttgaccatcttcgtttttgccagaacataaccgccggcggcttccgctgccgcggccacggggtccttccctacctcgttggcctcccgaatggtcttgccaatcttgaagcactggctgagcgtgccggggaccagcgcgtccttgacttccttaccggacatgatgtagcacgcgtgggctaccataccgaagccggagtcagccagcatcttgccgttgcgctcgatcatctggctgttcacacagcgcgtcaagatattggtgtcgccatagccgttgacgatggccaccggcagacagggcttatccataacaagcggcagcgcctgggtcatctgcggataggcacgccccgcggcgtccgcgtcgatatacgtcaggcccttgtcgaatccaacggacatgggcatgcagctgtttccgccgcccagctcaatggcaaacaatgcgctgatcttcttcccggtgtattcctccaggacatccagggacttggaaagcatctcctggggagaatagggcggatcaacgggcacgccgttgcgcttttgcttggcaatgatctcatctgttttgggggcgatagagcccatcagaaaaacagacgcataggtgtcatcatccttcagatcgtcaaagctggttacctggaggggcttccccttctccaacacctctgtcagggctacgatgccggcctcagggtcaccgccgccaccgcagccgaagaagcagcagccagtggcaaaatcctgaatatcctgctttgtctttaactcaaacgcaaccataaaagcgctcctcactttctaacttatcatataactgttgcgtaggattaccgatctgtataaatgctgatgtctggcatgtacatatccatgcccagcgcataatacttcagttcaccggtttcattgtaatagtccgcaacaggccaatcaatgtatgtggactgatacgcatagggattcgccatatcggcgactggtgccgacgcacacagctctgccatcacatagtcctgcagttccatggcagcggcatttctctcatctgtatccagaatggtgacagcagtgtccaaccgttcatccagctccggcgtggaaacccaggtgggattctcaaacgttccctgggttgcgctgccaaatagagtgcgcatcacagaagcggcgtcattgacagagggcgtgatgttgcaggtagatacattcggcgcactatccgggttggaaatctgctcctgataggtcagccagggacccttccggatattcatagtgatgccgacttgcgcgcagttggcctgcagggacagcatcattttttccagagctggagccgaatccaggaggaaacactccagttcaatgtcctgatatgtgtccgcatacctcgactgggccaagtattccttcgcctgctcaatatcatagttataagtcgtacagctgtcgttatggccgttgattgcggaggagaccggtccgacgctacgctctgcgccgtagaatacagggccgaggaaactctcatagtccagcaggcaggacaacgccttgcggtagttcagatcgtctgtgggggcggcctgcgtattaaagaagatatactgggtgcaggcccatgtggtaaatgccagttcaaccccctcaatctcatccaacgcctcatagttttccggagcaaaccacggagaagaaatttccagctcctgattggccatcatagtctgctgggtactgggctcagtcagataaatagcctgaaactgctcgggggcattttcgcggccctcccagcccatatgccagtcagggaagcggcttgctaggaaataatcagaatgcaccatctctgtagctgtgtagggaccagagccagcgtcgttgtccagcagccaggccatggcatagtcgccatattcgccgtaggtgccgtcatccacaatattggccatgaccgtctcttcgtccaaaatgtacaggtgccagatgatgcccataaaagaacccagaggctcggcgagaacaaatctcactgtgtaatcatcgtccgccacgcattcctccacggtgtcgaagaggtacgcaaatccctgtccaatcgttttgaagcggttaaaggaaaacacgacatcggaagctgtcaggtcgtttccgctgtggaacttcacgccctccttcagatggaaggtatactccaatccatccgggctggcctcccaatcggtggccaggttcggcgtttcatctggataggtgagattatcatacagattttcaacacatacgctgccgaccaagtccgtaatcaccgccggatcaatcttgggcgtactgtccgcagagaagcggatgatgctggggcgggtgccgtctcccgtctgagcgtctgccgggtcgcccgcagtgtctccgccgcacccggacagcaggccgacgcagctcaaaagggccaggaccaatgcaagaattcgtttcataatcttcctcctttattacagtcgtataatttacacctccggcggcagccgaaaagcgtgtacagagagaatgccctatttatctatcaaatgacagcggaccgtatgccctggctccacctcccgcatcaccgggtcttcttttgtgcaccgctcgcatttgtaggggcagcgggtgtgaaaactgcagcccgtcggcacattgaccggggacggaatttcccccacgcactccactgcctttggtttgatggtctcgtcctcctccgaaactaccgggatcgaggacagcagcatctgtgtataggggtgcagcggatttcgatagaatgtctcggtgggggcgatttcgcaaatcttgcccagatacatgatcgccacccggttggagacgttccgcattacgcccatgtcgtgggtgatgaacatataggtgaggttctgctccttcttcagcttgatgagcatgttgatgatcttggcctggatggagacatccagagaagaggttggctcatccagaatgatgaacttgggattgcagcacagtgcccgggctatggagaccagctgcttctcaccgccaccgatggagttaggcgacttgtacatgaagtcggcgggaagttctaccatctccagaatctcaaggatcttatcgtcaatctcgttcttgggaactaccttatgtaccttcagcggcagactcagaatgctgcgcacatcctgataggggtttagggaagagccgggatcctgaaagacgatctgcgcctcgcggcggaatttcatgctcctcttccgcttggtctcctttgtgaaaacctcgccctcaaagtcgatctcgccgcccgtcatcccgtacatgcccataacggtataggcaatcgtgctctttccggagccggactcacccacaaggcccatgacatccccatggttgatggtcaggtccacgccatccactgcccgcacaaaccggtcttttcccacaggaaagtactgcttcaggttctttaatgtcaataactcattcgacatggccgtctcccctctccttggcaggtcccttgtcctcatagaggaagcaggacaccgcatgattttctgcagccatgtatgtgcccggtttttcctgcttgcagcgttctgtgcaatgagggcagcggttgaagaaccggcacccctttggtggatttacataacttggaatgtagccgtaaatgccggctgaaattccgccgccggtaagccgcggcacacatgccagcaagccttgggtatacggatgcagcggatttttgaaaagctcagcggtatcgcagttctccacgatgtttcccgcgtacatgacgtaaatacggtccaccagctctcggaccacgcccagcgagtgggtgatcatgatcaaagagcgcttttcctcctccaccagcctgcgcagaagcttgtggatctgcccctgaaccgtgacgtccagcgcggtaccgggctcatccgcgatcagcagctgacggggcgtcagaagcgatgtggcaatgcagattctctgccgcataccgcctgataactggtgcgggtacgagttcagaatgcggtccgggtccggaatcatcacgctgtcaatcgccttccgggccgcgtccagcattccctttttgtcatgcttatcaaactgcccggagtatttcagcacatccatcatctgctggccgatcgtgaatacagggttcaatgccgccatgggcgactgggagatcatggagatcttgcggcgccgtagatccaaaagcgccttcgcatccatggccaggatatcctcaccgccaaacaggagcttagacccctctcccaccttgataccccgttcgtccagtgtccgcatgaccattttcatcgttgtggtctttccgcagccggactcgcccacaaggccgattttttcgcccttacccacgtacagattgatgtgatccaccacttcggcaaagccccgatatgtcttgtaccatacagagagatcctgaatatccagcaatttttcatccatcactgtttccccctgtccagcatatcccgaattccgtcgcccaagaagttaaagccaaggatgacaaacacaatggcaagggcggggaatgccgtcatccaccaatagtccggcatgtaagtcgacccttcggagatcatcgtgccgaaggacggcgtggggggctgttcgcccaggccgataaaactcagggatgcgcccagcagaataacccagccaacgtccagcgccatctttgtcaaaaccggggacaagcagttgggcagcagttccttgaagagaatatgcgccctgctcgcgccgacaagttcggcattcttgataaagtactccttgctatatccggtcgccatactatagaccagtcttgtataccatggccaccaggaaagggtcaccgcaatcatggtattcgtcatgttcggctccatgagggaggctatggtcatggccagcaccagtgacggcaacgccaggaaaatatccgtcatgcgcatgatgacggtgtccacccaggtgtggtgataatatcccgccagaagacccagaaacgtccccacgggaacagagatcgccagtaccaccactgccattttcagggcgccgcggaatccgaaaatcacgcgggagaggatgtcccgccccgtcacatccgtcccgaaccaaaacgtggcgttaggtgccacgccggcattggccagatccacataggcgccggcatgttccggaaacggcgccacatacggggcaaaaattgcgaaaatcagggagatcaccacaatggccaatcccaccatggacaatttgttgctgcggaagttataccagtaaatacagaaattctcccgggtggatggcttcagaaagccttttttctttttggctgcatccatctttacaggtcacctcccagtcggatcctcgggtccaccatagcattgatcacgtccacgatcagattgaccaccaagaacgtcgctccgattacaagcaccactgcacagacagagttcaagtccttggtaatcatcgcgtttgccccgtatttggaaaatcccggccagttgaatacctgttccaccatgaatgcgttgcccaccatagatgcaatgtccatgcccataactgtgatcactgacgtgctggagggcttgaacagatatcgattcatcaggactttttccggcaggccataactgcgggaaacgcacatgtactcctttcccatattgtccgtcagcgcggaacgcatcagccgtgcatcctggaacataccgcccagagaaagggcaaacgcgggcaacagcaaatggaggaacgcgtcccacgccgtggaaaattgtccctgcaccagggcatccagcacatagaagcccgtgatggtgtccggcggtgccaccccggtactcaatcgcccaagcgttgggattacctgccatagatttccgaatatgaccagcagcacaattgccaccacgaaggacggcaccgcgattccgatataggagaacacacggatgatactgtccagaatgccatctcggtgccgggccgccgcccgtcccaaaatcagggaaccgcccaccatgaacagggcggaccagaaaatcagttcaaaggtcgccggaagcagctgcttcatgtcctctgtaacagagcggcgggtggacagggaaataccgaaatcgccatgaagcacatcccgaaaccacaggatatactgcaccggcagtggcttatctaaatacatctgttttgacaggttatcgactgcctcctgggtcgcgtgctgccccaaagccaaccgtgccggatctcccggaataatgcgggaaagacagaaaatgacaattgaaactcctatcagaacaaatactccctgcaagagtcttttcagtatatagcgaagcacttttccaacccctttcctattgcagagccatttggatcacgtcagttcccaatcgacttttcgtgtcttttcttccaccggccaataggcgtatttgctctgggaaacgcccatcaacgcacaagaaagtgcgtcgtaaagagccgctctgaatggctcaatgaccggaatatcgatcccgtgttcctgcagttttctcttcacgccatccaccgccgtgctcatgcaggtacagccaaaaatcaccgcccgggcgccatcctgccgtaccgcttggttggcagccgccgcagccttgtccacgagagcctcctcactgttgtgaagttccaccactggcatgtgaatgaccggaatggatgccaactgccgttcaaagcaataacaccggatattttcacgaatacagcggtcggcattatccagaatcccgatcacagaaaagcgcccggccattctggcggccagtgaacagctggactggcatgcccccatcaccggaattcggaccaattcccggcattcagagagtgcgggatccagaaagcaatccaggacaatggcgtcgaagccatctttttccccctgctgcaccagctttaatatgtaaggcgcagccagagccgaatcgtaaaagcattcaatagactcacttccaccctcaacgatcctgctctcaagctccaccagtcccccggtttcctccttcagcgcggcggccagcgcctgacggtcctttacagagactgcgatcccctctgtataaatgtccggaacaatgttgaggattctgatctttctcatagatacctccttttcgcatcatctaattttggtctactgccgtgttatttatgttgaaaattatacgattggattttgtgtagaaatatacatttttcttgggcattattttcatcataacacacagcccttatgcaaatctcacatatatctagatgtccagaacagcagaagggatcagggaatctctgttgtaagcatctatggtctttccttgacatcttccttaagaagctgagggtagatttttaacagtaatttgcccaactttaagtggagcgtctggagcccctgctgtatctcatcggccagacgatagggacaggcggtagaacaccgctatgaagccgccggaacaactgcgttggcgtctattgcaaaggcccattcccattgtggaaattccctggcattcctcgctgatggagagacggtcgtgcaactcactgaacacggttctggcgggagaaatcaggagctggcattggccgctgcagaaggaattgcaggactggacaatgtcttaattttttccgttgcttctgatggaaccgatgggtccactgatgcggtcggcggaattgtagataggttcacgtggagccgactggaaaaggctggcctctccattcaccagatactagctaataacagcgcctatcatgctttgaaacaagtagatgggttgattcgaacgggtcccatagggaccaatgtaaatgatgttttggtgctcctgattcaacaagctgaaaggacatgaacaagcgactctgttgtgattacgtatcgtgggcagcaagtatcggtgccgaaggctttctggagcgggatcggaagcgggaacaggcgtggtaaaaacaggaggaaaggcatagcatatcctctcgaaataaaacctgaggagaacaagcagggactgaacgcccgctgaaagattgaagcagtccgtctctccaaagataaggttacagggtgttaagccctaattattggtgcttgaaagagcgtccagcacatacctatttagtccaacacgaggttgagcctactcacctccacgtgctctgtagtacacctgcttcctcaagcctattttaacaaatttcaacttgctgtatgagaggcacctatgtttcatccattttggtgccttggagcgtagcggaaaggaatggtcacacctatggaatttaaagaagatattcaaaagagacgcacaacatttcagtttactggtacaccggtaacagcggaacagattaagtggattattcgggccggaatcacggctccctcttttgaccacaaacgcaagtggaatcttattgcggtcacgtcggagatggcaaagcgaaaagtcaccgactacattgaccctctgccctgtaaggacactcctcctgaaaatccagtgcaggagatgattcagatcgctttccccaagcaaaaaagtatgtgcggaagctggatgtgtccttctgccgctgtataagcgggaagcacagatcatgatggaggtcgggcccagaaaactgatggactttgtcgagatctggtgcgtcatcgaaaacgtcttcctagctaccacagacgagagccttggccgctccatgcgaattcccacagaggaacagccgaggaagattttggaagtgctgggctgtccatcaggataccagcttccttgcatcatcggaatcggccatattgcagaaggggctgaatatcggagcaggtttatccggatttgacggagtgtgttcattggaaaattggtgaaaatacctcagcggaatttttatatgttgcttttgtgtccggactggtagtctatccatttgtcctacacagtgcttagataatttactgctacctatcttatttcctataaatcgccggggcaccaagattctccttcctggtgccttggcgatttctccatataaaagcctgtgaaaactgagctggattcccgccagcaacgtgatgaaggcatcgccttgacatatgcccggcgggaggaaataatcgacacttgtgaaatctccaacagcaccaacgcagaaactgcgccgcatcagcaatgaaaaggccagctggattaggagttggatcaatcaatccggccgtttcttttcctcggtttcatattcattctctcagattcttgcgttgtccgtcatcgcttcattttcttttgcccacttgctggattacgcatatcgctgtcagaggaagtatctgattggcaaaagcactgaatcaagatgcttgaatctgtgtaattctctgaattttcttcttgtctccgctcaactccctgttttgttgcttgtacatgatgagaggttgtgtatttctcaaatgcgggggaggcatcgtgaaagaatcggactgcaaacgctatgaggatctgccgctgtttctgaacacggcaacagtggcaaaacttcttggtgtgtcacaatccagctgctacgagctcatgcacgagccgggcttcccggtactaaagatcggcagcaggatggtcgtacccaaggagcagttcacccgctgggggatgagcatacgggaggtggaaaatcaggtacggaagtggaacctacttctctctgcccgacgagatcttcctgctgggtctgaatgccggtgaactggcagtgtatagttacctcaaacggtgcgaggaccgtaagacgcatcagtgctggcccaacgattgggagatctgtgggtatgagtgaaaacacagtgcgcaagtacatccgccaactggaggaacaggagctcctcttcacagaaccgacagagattatgaccagggccggtcagaagcgcaataggaatctgcaccacaccctccgtcccacccaggaggtggtaaatgcgtactatgaccgtcagttggcgcggctggaaatcacagtaatgcgtcagaaggcagcagcggcccaggccggcatgtgaccgcctgggccgctgtgtgcggaggtgacagcgtgggcagggtacaggcattccgtgtggggactgtgtgccgcagctcccgttattgattaacgcctaaatgggcaggtggaccgaggggggaatcgtgcaggataaaggccggggtcgccggtagcacctccggccggtcacaactgcccgcagtgcgggcagttgcgagggttttgcggtgtatcaaaagtgggatcaaaatccgacctgtgctgtcacctctgcggtcacgaacccggaacacctactgtcacaacaaaaaaacagaggtcaagccccagaaaggagcagtttatgggcagaaaagagaaattcgccttctacctctctccggagaagaaggccatcttagagcggcggtaccgggaggattgaagccgcagtctcaccgccttcatcgaacgagccgtcgacttctatctggactgcttcagcgccaacaacgcaggactctttctcccggcctccatcaaatcctatgtggacggccgactgggacagttggagaatcggatgtcctctctgctgtacaagcaggcagtggagcaggatatggtagccggcattctggcggatgcctatcaattcaacgaagatgatctccagccacgccgcacggagagtatcaacaaggcacctgagtaaaagtgagtttgaaacggtgctgtctgcctcagattgtgtcaggcatcccgtggaggatgctgtacttcagaacttccaaccgggatgtctacgaaaaactgttgatggtcttggaattggggtaaatgtcaaatataaggggcaataaaggagtgtgggcgtggctaaagccacacccacactcctttatatcctcctgtatttgacatttaccattttgtgtgtgggactctctcttatgccagtttcttcactctattttcttaaaacaacagggttataactttatagagaatgaacaggaacatgatcacaaagccaccgcaacggctcactacacgtctccaagaccgctgttcctgacagcggtccgcatggataagtgccgccagaaaaactccgctgcaggccagcaacaccgcccatagaaatgttgcattgggcagagcagtttcccatgccagcaacaggacgcagggaacaagaatcaaaattgaggcggcgaattctgccagctttctagcgacataagcattcacctttttccctccttcagcattttcttggaaaagagatttcctgttgcttatgaatgctgtgcggcagtcttccgcaacagttgccgcccagcatccgtcagtccggctttcaatcgtccttggccgaagactctcaccagtcccagatcggagagatgttcagaaatggcactcagttccatcatgtagatggaatgctttccagagatctcgctcatcgtggcatcgtccttttcgatccaatgcatgaactggattgcctgactgtccactccatatacggcaatggtcttcaactctgtttcactcatattggcacaggccgcggcatcgcctttttccgtcagggaaaaatatagctgggcaatcagccgctgtccctttcgcttgacatagccgctcttctccagagaatccagcgcattgtggatatggccagcctgtagctgatgctcattgcagaagcgcgtcatactggtgataatagcgccggcatttgaatatccacgcttgatggttttcagaatctccatctgggcttcattgggtcccgtcttttcatccacaggaacaacggtatccttcttggtcagaaagcttacaatcaccagcgtgaggaaagaggccgggaaaatcagccagaggctgttcatctgctgggagttggtggttaggatatcccagtacagtacaatggccatagacacggcaacagaggcaatcgctcccttctggttgcctacccgcaatagccaggagtccagatagtagacaaacaatggggcacccactcctgtgccgaaagcgaagagatagctcagcccgccgctccagaagatggcgaagaataccgaggccattccatagatgatggtgccccacttcgcccactgcaggagctttttggtatcacgaattttcaggaaatactgcgccacatcacggactagctgattcacgccagataccaggtagatgtcgcaggtggacatggtggccgccatcaggccggccataatacaggccgccaaaggaatcggcaaaatattcatcaaggctccgaacgcctgactggaatccgtcagtcccggcagaagctgccgggcatagcagccgataaaagctccgacaacaccggtaaagtaggcgatgatcacagtccacatccagccgcgcttgcagttctttagactgcgagtacccgccgcccgggcccaatacggagactggttcagcagagactggtgcatcatcaggaaggtgatgacagacggtgccacaaatttgatgacagggagcgtaccgaaaggaagggagaggaaagcatctggtagcgccactgcatcaggcaacccgtacttcgcgatcaaaaaggtcggcaggatgatgaactggataatgaatacccaggagaactgaatcacatctgtggcggtagccgcccagatgccgccgaataccacgtaggccgtgaccaccacacctaccaacagcatcgcgattttggggtcaatgcccagcgcaccgccgatggtctcgccgcatcccacatactgccagcccagaatggctagggaggcaaaaaggattacaatggtgatggccatgcggccgccctttccgtagcggtattcaaaccactcggtgggcgtcagggcgccggatgtccgccagaagccggcccagcacagccaagccaccagagctcctgtgccccagcccaagtagaaccacatgccgcccataccgaacatatagccgtacatgataatggagggcagataaccgccagagatcagaatggaaccgttgccgatggctgtcatgaaggccgtaaactcccggccgccaaccatgaattccgtctcatccttggtggtcttttttccgatgatccagctcagtagcatcattgcgcatacgtagaccacagtaattaggatcatccacatttgtgaagtcatacagatacctccttacgtatgaacatttcaccagcattggcattatccaaagtatttcttgttgacgcaccacatgtcgtgtccagtgaggaaccacttaggctcttcccgctccgccagcatcataatcttgttgaagctgtcatagcaggcatagtggtcatagataacgctgttgaggataaagggtccccagttctcaggtgcaggtgtgatatccacaatttcgccgccaatgacctccatcttatccatctgcgggaagagagactgggcaatatggggcatatcgccggtaatcacatacttgccctctgcagtctggacctgaatggccataccgcctagggagtgaccgggaaccttgaacaggcggattccgtttcccatgtcaaaatcgccatcaatcatgcgtacattcttgatctgtgcaaggtcgcctggcgtgcgcgggtcataatctcttcgaatcttctgtgtgggcagggggtgaagcatattgtaatactcatccctctgaaacaggtgctgtgaattgggaaacagcagcatgccgcctgcatgatcgttgtggaggtgggtatacatgacaatctcaatatcgtcgggtgtcagaccttctcctttcagcgcatccaaaacaaattgattgccgccctccgccggactgtccgcccaagctttgccatcgacaatgttgtcctgatgaacaccagtatccacaagaatatttctaccatccttttgcaggagatacccactatagacaaagggatatctcgtttggtcaagcccaccatcaaataaggacttatagcaggacagcgtaccatagtgcaggcaggtgattttccagttgttgttcgccatattttccatcctttctactccaaatgtgagccggtgtttcattcactccggcatatgccattgccggacgccctcaaaatagggagcctgcttccggtatcggaagtcatcctcgtccttttcagaccaatcatagagtccttggcccgccttttgccccgtgcgcccggaggcaatccccaccagagtggtcttttggatactttttgtgtcgcagagatctggatacacattcagtgcaatggccctttccaactcaaagccaaccgcatcgtaatattccaaaagccctatagaagcgtaccgcattccaactgcatacttaattgcccgatcaatgtccgccgcagtggtgatcccctgctcaatcaaataaatcgactcgcggaacaatgcctgggcaaaacgatttactaaaaatcctgggacactgcgattcagcatgaccacttgtcgattcaggtccttcagcagcgtacagacctgattcagagtttcctctgatgtctctgtatgccggacaacttccaccaggggaagcatgtggacgggttggaatggatgcgcaatcaggaatcttgcgggattttcaattttttctgccaggattgcagcatcaatggaagatgttgtggataccacaatgatatctctgccgcagacctcggtaatgatgctatacacacgctgcttaatgttcacatcttctgaaaccgcttcaaaaacaatgtcacagtctctaagggctgagacatcattggtgatcgtcaccaggtccatcgcagcacgccgattggccgcagtcgccaatttctgggctataaggtcattccagttttgcagcatggtgtttctgcagcgggatagtccctcctctgaatgtccaattacaacggtggaatatccattgccagatgtcagcgtcgcttggcacgcgccgatcgttcctgccccataaattgcaatttttttccccatagaacgcctcctctcgttttgaaacagcattgtcagggccttgacgccttactacctaagcaaaaactatgccaagaatggaaaatacaaaaattctccattcttggcatagtgtgttgtaaaactgtacaactcccctgtttgctgagtctttaaagaagttgatacttatgaagttttttatacaggattgtgcgggaaattcccaaattttgtgctaccaaggtcttattaccgtgaaactcctgtaaaacttgcatcaggatatccttttccagctcatccgtccgttggcgcagcaagcgcggcggcgcggcagagtttaatgtttttgtttcatatgcgtgatgtttaaaatagtccgaaaaatacttccactccagcgtctcaaaccaggcaagattcatggcccgttctaaaacattctgcagttcacggacatttcccggccagtcatattccatcagacgctgaacggcttcctgagagattcccgggatttggaggttcagccggaaattcaactgcttcatcagccaatcgatcagcaaaggaatatcctcgcttcgctctctcaatggcggaacatgaatgcataccacattcagtcggaaatagagatcactgcgaaatttttcttccatcacaagcttttcaagaggcgtgtttgtcgatgaaataatccgcgtgtcaatggggattgtggcagaagatcccacacgctcaatctcccgctcctgcaatacccggaggagtttcggctgcagggcaagcggcatctgattaatctcgtccaaaaagaggctgccgccatttgccatctcaaattttccaatcctgcctcccctgctggcccccgtaaaggctccctccacataaccaaagaattctgattccagaagttcagcggggatcgctgcacagttcactttgatcaggcgattcttacatctgggactgagttcatgaatggcatgcgctaccagctccttgccgctgccagtttctccatcaatcaaaaccgtggaagaggaccgcgctgcacagacaatttcgtgcttcattttcagaatctccgggctgtttccgacaatccgatccaagggatctacggtattttgctgaaaggactgaagcagttgcatctggcgattcagttcttccagcagtgaaacgacatgagagggaaccgccatggaaacatcctcattctttcgaatcatatagacgagacaaccctccaacttgttttcgtgaaacagcggtgtgtaggagcaatagaccggtacctcctccccagtttgactgttcaggagaatcgcatccccagacacaaatttttgagtctttaatacctcatccacgcgggaaagccgaacaacatcccggacatatcggccctttacctgctcaaatgtatacccggtaagtgatgaccatcgctggttgacataggcataccgtccctctgcatccgcgacaatgagtccctccagttcatcggcaattctttgcatcaatgcttttgttgaaatttcatgtagactctggaccatcaagggaatttctcctcctttcgatttccgttattttaacgaaaattcacacagctccccggttctgttttggaagaattattgtaagccaattttaacacaagttgtaaacactgtaaataaatacttacaattatgtaaaattgttacagtacctaaaaaattctcccaaaaataaaaagctggaaagtaaaaattgctgcactggtactgcttacgctgtggcaacatggctatctatcatataatctctctggcttttcaaaatacttagccatccgtttctgccgtattctcaggaacggcctgccgctaatcagataaccatagggtgttcctatattcatttctaaaattcttcccccttctctccaccgttttcattgattctttgctaagtataacatcggcacagtcggaggtttccttttacagtcatagtcaccggctaagccgatggcttgagtaggccctatgaaggcctattaccggcaagcgtctcaaggcgcactgaaatttattttgcttgcatcacttgccttacagcctgtaaacgggtaatcatcgttctaatagtagctttctattattggaagtctcatgccagcggctcacttcgctcgatgcttgaagctaaagctcctctctcgattgacaactttgatgcctgcgactacatcttcctgaatcacgcgcacccggaccactacctgaacatcaaggagtttgtggacaaattccaccccccgatctctgtggacagcctgtatgcggcggaactctcccgcaccataggcattgagctggcatacattttcccggtggaccggacacaactaccgcttcccggacttccgcctagatgtctactacgggagccacaacgcgctgacagggatcggcttcgacaactataccttcacggaaaagctgtttggcatcaagggcacggaggcgctggatcaatacggcagcctgttcaacacgaatttcatgttgaccctgcccaatggctacaaggtcggctctgtcgccggaatcgacaatctgaaccaagcggaggcgtggcggaacaatcagccaaatctcctgctgcaccagcgtatggtgtacacaaagccggaggactatgcccaagaagtgatcgatctgggcgggcagatggggattgtggaggcgtgaggtgcctctgcaagaaggcgggagcgatgctcccgccttttcaaaactgtctgtccttatttctgccacttatcagattttgatatgcgatacaaagaaaaagcattggttgcaagcccacttgcgatacgctgatcaagcagaatgacggcaccttcttcgactggccggtattctgcctttagctccgtgaactaaacgtactgaaagttacggtgtaggctatcaagaatattttgtctaaattttgatttcaagattgttagaaatgcagaaaacgaataagctcctacaggattttcggaggcccggcagttaccttgccgggtctcgctgtatcctcggaagtaaggagcgataagtgggagtgagatcattgggaccctcggaacagagacaagcgatatggggctacttatgcggcgcacggtttggtacaacgaaacaactggcaaatcgatttggagtttgtgagcggacgattcgaagcgccctggtcatgttatcctgtacatatcccatcgagacttcctttggtctctatggaggaattcgcgtctcagattggcaccacccagctcaaacgcaactgtcggcagctcaaatatcgcctttgctaagagtccgaatggatctggatggtgaggatttgaaagtgatgaactctatcctcatccaatttgcttttcctggaagttactaaaatgagtcctgcttcccgcgaaaaagcactacagctagaatgaaaatttcaaaaagagccgggacaaatataccagaagtgaaggatgccagagagacccactccgtggatgagttcctgcgtttgatccatccaaatgttgtctgtgaggcttcgaaaagggatgctgattgaaaaaatttcgagacccggcaaaaaggctgccgggtcagctgatagactgaaagcacaaacattggatcgagatctactggcaggaggtgcgtatgaaagagtcccattacaaaagctatgatgatctgcctctgtttctcaatgcaaaaacagtggcaaaggttctgggcgtgtcaccatctagcggttacgagttgctgcacgacccgggcttcccggtgatgcgcgtcgggaaccggatggtggtgcccaaggagcagttcatacagtgggtgagcgatcacacaggaggtggaacatgaagtatagaaattaccgagacgttttctttctgcccaacgagttgtttcagctgggactggactatggagaactggcggtctgcagtttcctgaaacggtgcaaaaatcgaaagacacatcagtgctggcacagcatcaaaacgattggccatgcggtaggcatgagtgagaacacggtgcgcaagtgcatccgccgactggaggagcggtagcttatctccaccgagcctaccgaggtcaccaccaaagccagtggtcggcacagcggaaattttctgttcaccctccggccaattcaggatgtgatcgccgaatcctacgcctgacagctggagagggtagaattggctgcagagcggcaacgggtcgccaagtccttccaggagctggagactccagcgtgaccgcctgtgagccgctgtgtgccccgtttgcgtgagctcttgcccctcccagtggcttcggacggatttggcccgttttgggggttttacgagggacgaaaaaaggaacaggataaacgtcggggtcaccgatggtgcctccagccagtcacatctgcccgcagtgcgggcagttacaggaattttccggatgaccgaaagtggggtcaaaacagccagcgggaatcacgtttgcggtcactatcccagaacacctactgtcacaacaaaaaacagggagcacgccctggaaaagagccgcttttgagcagaaaagagaagttttccctgtacctgacgctggagaaaaaagcaattccggaacgccggtatcaggaggacgggggccgcagcctcaccgccttcatcgagaatgccgtagatttctatcttgactatctcagcgccaataatgctggtctattcctccccgcctccgtcaagtcctgcctggatggacgctgggacagctggaagatcgcctgtcttccctgccttcaaacaggcagtggagcaggacatggtggctggcatcctcgctgacatctaccagttcagcgaggaggatctccgccgttgccgtgcgcagagcgtcatcaatgtgaagaaggccaatggccgcgtctcgttggaacagcgggcgcgggagttctgggagtaggacgatgagtggcaggattgatcgtgaaaagcccctacctgaagtgtggcgaggatcattccgtcagtggatacctccactacatcgggaccagggagcgggtggagctgctcccagatgaccgtccgccaaccagaaagcaggagcagttcatcacgaaactggtgaaatattttccgaatgtcaaagagctgaatgaattctccggctacgaaaccaagcctaccaaggccaatgcctcctcgctcatcactagggcgctggaggaaaactggtcagcactacagaaaacagagggctacatgaagtacatcgccactcgtcccagggcggagcggctgggggcatggtctgtttagtgatgaggacggcgtggacttggcaaaggccatggaagaactggaccactacactggaaaggtatggacgcacatcctctccctgaaacggaaggatgcaacacggctggactgcgacaatgctaaagtgtggatgaatctgctccggacaaaccacaacgacatcgccgccatgaacattccgccgaatcacttccgatggtacgccgctttccatgatgaggtgaagcacccccacgtacacatgatggcgtggtcggcggtacccggtgaggcctatctcaccagagagggcatccgcaagatcaagtccacgctcaccaaccagatcttccgtcaggagatgctccacacctacgagcagaaatctcagtcgcaggatgaagtggtgcgggaagctcggcagaccatccgaaaactcccccaggagatggctcggactatctgtactcgccctgagatcgagcagaagatggcgcagttggctgaacaactggaaacggttaagggaaagaagtcctacggctatctctccaagccggtgaagaaaaccgtggatgaggtggtggacaagctggaggaactgcaggtagttcgtgcgtgctatgaccagtggtgcaggctccagggtgaggtggaaagctgctaccacgacaagcccagagagaagaaaagctgtcccaggagaaggagttctggcagatcaagaacgccgtcattcaggaggcggaacgcattcggctggaggagatcaccttcgagaatgatgacttggctgagtgcgatgagtcggaacaggtgcagagcgagtcctctgcctgctgggaactacggcaaatcatccgggacgcgccctttcctctgaaagatcagaacgatgcggcagaggaattggaacggctggcggaacagagtgatctccatgcgcagtacctgatgggtctactctaccgggatggccttctactgatcccggacagccagagcgcgaaatactggctcacccaggcggcaaagcagggattgccggaggcacagtacgctctggacaaactgctttctctgacgatcttgaagtctgtgattcggacgggggcatccgctgcttgaaagaagcagctgggaacgggaaccactttgccgcctaccggctgggcaagaagtatctcagcggcgaggttgtgtcaaaagatgcagtcagagtcacagagcgcctcacctagtcagcggaggcgggaaaccagtatgcccagtatatgctgggaaagttgtatctgactgggcagagtgttcagccggatcaggtccaggcaatagtgtggttcggcaggtccgctgagggaaatcagtacgcccagttctttctggagcggcacgatgatattcgaccgccctctgtcatgctggcagttacccgcctgctctaccacatgagccggagctttgaggactgctccctgcctcgatccagcactggtctgcgcatcgaccggaagcgccggcagaaactccaggcgaggcgtatcgctctgggccacaagccggatgaccatgaggatgagtagcatcaggatgaaatgacgatgaagggatggtgagctgcacgagaaaggaaaaaggcctcccgcaaatacgggaggcccggcagatcaagaggtgccttctcccactccgcccacatagaactcggccatatcgtccagccgcaggcaggccaggcgtcggtgtgccgccttcatgctgccacagccgcagtcgatgtcgaggatgccgtctccatgccagattgaaaagtcctcgtcgtgcccatccgtaaggaacaccgtgggcgtgtggccgacaatgcagatggtgtccggaaaggggcttctgttgtctggctccacccggccccagatgcgggtttcgtgcccctctcccggatacccgtgtaccagatgaaacctctgcccacccactgtcaggtccagatagcccggcaggccggcgaggaaacacaggatcccattccgctcttggtgcgtccggtgatagatcagctcccggtaagcagacgaacccgccgttcatccgccagaggtcccgggcgccgaactcgttattgggttccagggtcctcaggcacatctgcttgtggttgcccagaagcatggtcatattcgtcgcggctatgatcctccaaaaaatgtccccacccaaagtcccccggacgataacgcctcccagaatgtatagatggtcctcaccagagaatcggatcagctccagcatctgttcaagcttatccaactcgccgtggatgtccgatatacagcagattaccggccgcacctcctgcctgaaaagtgatacccgcattttaccatagaatgtctgcggatacaacggcggtgtccccccttcaaattttgcagggtagtatgcgatatacgcgtttcccaaatagaaactttctgataatagtcctaattcagggtggctattcttctgcgattgtgggattgtccgttgctgagaaagggaagctagaatatgcacactgtcacacgcccatcaggaaggtcaacaaggggattgtcagaatcgagcagagcgtggaggcaaagatgatctgcgatgcaaatatggcatcaccgccgtatttgtctgccaaaatggaagtcgtgctgcctgcgggcatccccgttatcagaatgcagacattgaccagcgttgaatccagcgggaacggctttagcaccagccagatcagcacgggaaagaacaccaaccgtaaacaggtgtaccatagcacggatttggagaatagagatcggattggcgcatccgcgagaattgtaccgatcacgatcatggaaagcggcactgtgcagccgctggttatgtcaatagcttcttctaagaaatttggaagtgagatcggagctaccatcaaaatcaggcccacaaataccgcgatgatgcagggatgccgcaccaattttcggaaggcatcttttttactgacatccgtaaatagggaaagacccgctgtccacatggtaaagcgaaggggaatttgaaatacggaagtatagatgacacccagatccccgaacatcagatgggcaatcggcagccctacaaagctggaattggaacagatcatgccataggacagcacacttttctggtttgccggataccggcggaacagcagcttgcttccgtaaatcgacagtacctgaatcccgatggagatacagacagccagaatgcagttgtgcacaaagccatcgggcagtgtgatcccacccataaaggacgctacgatattacaggggagaatcgcataaatcagaagatctgaaagggttttccgcccgttttcgcggatgatcttcaattttttcaccagcacacccaacaggatcagcagaaacagcgtctcctgcagggataacatctcccagaaaaaatccatctcgctccctcttctccgcaaagcttattccaataaaaattctacaatatattccgataggccataccatttttatccgaaatagggcgcagggtccggccctggggccggaccctgcacgaaaaaaggatcgtgtgtgtccgatggtagcaaatttggaatgcggtaccgtgcttacaggatttcgcagctgatttccttcagcttttcatctacccagggacggatgtaggtgccgtcccccagaatatgggccatgatgtcggcttctttcttctcaaccgcctcggtggcatccgccagctctgcggcgatggcgggatcaatgaacaacacaccgtcgtcatcgcccactacgatgtcgccgggacggacgagttttccaccaatcaccacggggacgttgatctcgccggggccgttcttataggggccgttgggggtggcggaccgggcgtagacgtggaagtcctccatagccgccagaccgccccggtcccggatggcaccgtcgcagacgatgcccttgatcccgcgggccttgcagtaggtggccatcagctcgccgaaaatggcccggtctgtgaagccgccggcatcaatgacgatgacatcaccgggctttgccaaatccatggcagcgtgaaacatcaggttatcgccctgagggacccggacggtgaaggccgtgcccagcagctgtcctttgtatccaatgggctcgatggccgcgtccactgcggcgatgcggcccatgttgtcatcgatgttggccaccggcatatctttgaaccgggtcaccagctccggggcgggccgctgaaaatcctttacgatcttgcatccgatagacatgatctcattcctccgatctcagataaatgtaaagccagtctctttattcagtacgtctcggtccgccacgcagcgggcggctactttacctgtagtcacggcggtggggaccagatcgcagaccatctggatctgggtcttcttgctgcccacgccatagctgccgcagtgggggttgacgatgacgttgtccagcgtcttcagcgggtcattttccggcagaggctcccgctccacggtgtccaggccggcgtacaggatctcgccattttgcagggcccagaccatatcgtcgttgtcgatgacggggcctcggctggtgttgatgatcatggcggtattcttcatctttttgaagacttctttgttgaacacgtgggtggtttccggggtcagcacgacatggatggagatgatgtcgctgcgggtgatcagctcctcaaaggacacgaactctacatccgggtactgagctttgacggcatcgctgatgtacggatcgcagctgatgacctttgtgccgaacccattgtggaagatatcgtggagatggcggcctgccaggccgaagccgtagagccccagagtcaactcccgcacatcagggggcagcaggtactgacatttgggccagttgcccttgcgcacctcccggtcatagtaggcggtgttgcggatcagccccatgatcatggcggtggccacgtcagccagctccttggcgcagaagccaggcaggttcaaaacgatcacgcccagctctgcggcggccgccaggtcgatgctgttgacgccggcgccaaaccgctggacgaacttcacctccggcagggtctccatcaccttgcgggtgatgggcgggttgccggtggccaggagcacctgggctccttggcagcccgcgatgatctcctcttctgtgggctccttctgacgagtcgcttccacctggtactccagcagctccatctggatcccggccgcctgataggctgccgccacacggtccagttcttggggtgtgacgctgccgtaatctttgtcaacgacaattgctctcataaatttgcctccttcaaaagtcgcttacagaggccagaaaatgggaatgaagatcatggatacgatgagaatgaccaccgtcagccccaggccggggcggaagaagtccatgaacttcaggttgcccggacggacgatcagggtgttggtgccgctgcccaccggggtcaggaacggagcggatgctgccacacagatggcgatggccacggcggtggtgttcatgccaaatgcctgcacgatgggaatgaacaacggggtgaccagcatggcacaggaggtgttcatcatggcattggtcagcagagttaccagaaccagaatgataaacagcaccagcaacttgttgggatgttcgcccagcaggtttaccgctgtatcggcgatcagggcgccggcaccgcttttgctcatgcctgtggagacagcgctcatgccggccacgataaatagagtggatagatcgatggatttataggcatcggactggctgatacagccggtcagcaccagaacaaaggccgcgaaggccgccaccagatacatagggaaggaatcactgtcgatggccatagccaccaggagcactgccaagatcaccaggcacagcccggcctttacggcgttgaattccacagccttattgctgccggtatattccgccagatattctctgtcagaggtgtcgccaggggtcaggaaccgctttccgatggtcaggaagaacacaatgccagcaatggagaccggaatgcccactttgcccagttcgaagaaggtcatagtgggaacgcccagatcctccagggctccgttgaccactacattgctggccgcgcccatcagtgtcaggttgcaaccaaagcttgcggcgaaggacatgggaatcagctgccgggagacggagacacctgcccgctggctgacgctgatgacgatgggaagcagcatagcgactacggctacgccgctgcacaccgcggagataattgtagccaccagcataaaggcgatcatgatgccgttttccgatgtacctgtgaatttgaccagaacatccgccatcttggcggcgatgcctgtgtggaagagggcggaaccaaccaccatcattgccgccaccaggacgatggtgctgccggaaaaggcgctgaacaattccgccgggtcaatgatcccacacaacaccaaaacactgccacccagcatagccaccagggccgcggggagcttctccgtcacaaaaaacacaaccataaccagcaggaccaatagcgtaatcactgcagggctcataggagttctcctttcttttctccattcatgtacggtgattttgcgaaagtgcaaaatccatattggtttttcttatcagacccttggtcctaaattttctttacataggcaagattgtagcaaaatatgcgcattttttgcttttctgtcatcattttaacgtctatacttgcttttgtcaaaggcaaaaggtaatataaagattataatgtcaacattatactagttgaggaggatcggatcatatatggtcttgcataactatgagtatttcgtagccatcgtagatgaggggagcctaacaaaagcagctgagcacctgtatgtctcccagccttcgctcagtcagtatctgaaaaggctggaggcgaatctgggcgtagaactgtttgatcgcagcgcctcgccgctccggctgacctataccggtgaacgctattatcaatacgtcctgcagatgatgaagctggatgaaaatatccgccgggaatttcaggacatcaaaaaccaaaccagcggacgcctccgattaggagtggcgctgtggcggggcgcttgcctgctgccggatgtattccccagctttcaccggcagtatccggacattcacatcgaactgactgaggggcgctccgtccaactggaaagcgcattgatgaacgataaaatcgaccttgcagtgatgaatctaccccgcacgctggattacagcaaactggtatcggaggtcgtttgcgaagaacggattctaatcgccgcccccacacaacacccttatgtgcagaacttacttgcagactgcccgacccttggaggctatcctgttgcctcgctggagctggtaacccatattcccctgatcctgacgaaacccggacagaatttgacccacgaggttaaacacgctcttgggaagagtcatattgagccagatctccttatggagacagccaatctgaccacagctattaatttgaccgctcagggcattgcctgcgcttttgtgccagaagagggtgcgaaagtctgccagcaccctggcgcagtgacttattttgcagtggattccccggatctggtatgggatttagcggccgtgtatcggaaggacacctatctgacgcgtctttcccagctgttcattgatgtcatgaaacagcagctccgacgagaataagcggtgttgaaaacggctgcatacggaaaaatttcacctgctcatacggggcaaaaagagcgttcagcatgccagcggctgccaaacgctctttttgcagggagagccccaaacccactttgtggctaaaggccgaaggataacggataaaaggtagtatatacattagagttttgacaaaaaacacgcaaggtattttggccccacaaataactcagaatttactgtgcagtaaacaataggatgtctgcggatacaacagtggtactccccccttttcaaattttgcggggaagtaaacaatatacgggcttcccaaatagaaactttctgataatagtcctcattcagggtggctattcttccgcagttgcggtattgtgtgttgctgagaaaaggcggccgtaatatgcagcgaaaactattggaaagcggaaacatcttcaaacgatcagacggccgctggaacggcgtggtctggtactcggatgagcagagttcaaagaaacgcaaatccttctgcgggaccagcaaacaagaggtcaaagataaaatcactgcctaccttgccgacttcgaccgccagctcacggcctcagatgagtccaaggcaaagtttgaggaaagcatgggcaagtggctccgggtattcaaatttccctctgtggagcgcggcacctacgaccggctggagtgcaccgccaagtatcagatctacccgatcctcggcggcaaggtggtgggtgacatcacctcggcagatatcaaagccctgctgaatcactggatgaatgagggctacgcctacaccacagtcaagaaggtctacaacatccttaccgactacttccgctacctgactcaacaggagtacatcccgaagaacccaatggctgcggctcccatgatcaagaagtcaaacttcatggctagccagggcaaggaggatctgccaaccttcgaaactgtgaccatcttcaccccggaggagatcacaaagttcaaggcggaggctgtcaggacctgggaaaacgggacgcccatctatcagcaggcggccgcctatacgctgatgctgaacaccggactccgcacaggcgaagccctcggactgctgaacagcgacatcgatctggagaaccgcgtcatccacctccagcggggcgtgaaagaggttttcaggcgggaaggcaccgaatccaccagcggccgggaggtgaagatcggcaagctgaagagcacctccagcaaacgggatgtgcccctcaatcaggcggcagtggacgccatcctgactctgagagcggagcgatacttcggagaggacagccctctcatctcggatgaacacggaggttatacccggccggtaaacttccggaaacgatactaccgcattctggaggcggctggactggagcagcggggactccatgccctccgacacaccttcgccaccaatctggtcaacggagtcaaacagccgaatggaaccatccgcgcgctctctccccggcaggtggccgacctcctcggccactccacctcagagatcacagaactctactacgtgaaaaaggatacctcccggctggcaggaatcacggcaggattcgatctctaaagcaccctccaaaaaacgcgcccctgaccagaaaccaactggccagggcgcaaaactttgatgctaaaatgatgctgtagcagacggaaacagtaaaaacggatgacgccagataccacattcagggcatcatttgagcgtcacccgcggtctcccgaaaatcattccctcgaaaaagtaacaaaaaaccccgataaatcggggttttcggaataaacaatggcaggggcagaaggattcgaaccctcggcacgcggttttggagaccgctgctctaccagctgagctatacccctatctcgcttgcggcactcccgtcaggcgatcaaccattctggtgggccttcagggattcgaacccgggaccggccggttatgagccagctgctctaaccaactgagctaaaggcccgtatcggcatttccttcaagagaagtattgccgccacgccgagtggcggcaatacttggctcccccagttggactcgaaccaacgacaccgcggttaacagccgcgtgctctaccgactgagctatggaggaatgtggcaggcccttgttaaaaacaagagcctgtgttggcgctacctatcttcccgggccgtcaccagccaagtattgtcagcaggaacgagcttaactgccgtgttcggaatgggaacgggtggaccctcgccctaatcagcaccaactctatgtcatccggtcttgccgaagaacaaactgtattatattgtatttcgcttcccttgtcaagaactttcgcccttgaaaagtctggtgacccgtaccggattcgaaccgatgttaacggcgtgagaggccgctgtcttaaccacttgaccaacgggccatggtgcaccttcacggactcgaaccggggacccactgattaagagtcagttgctctaccaactgagctaaaggtgcaaatcccttgagcatgcttccctgcaccctcaaaaccgaacaatgtgacgctgctttcaggctcgcctgctttctcgtaggtcaagccctcgggctattagtaccggtcagctccatacattactgcacttccacctccggcctatctaccaggtagtcttcctgggcccttaccctctttcgaggtgagagatctcatcttagggggagtttcacgcttagatgctttcagcgtttatctcgtccgtacttagctacccagctatgcccttggcaggacaactggtgcaccagaggtacgtccatcccggtcctctcgtactaaggacagctcccttcaaatctcttccgcccgcaacagatagggaccgaactgtctcacgacgttctgaacccagctcgcgtgccactttaatcggcgaacagccgaacccttgggaccgaattcagccccaggatgtgacgagccgacatcgaggtgccaaacctccccgtcgctgtggacgcttggggagatcagcctgttatccccagggtagcttttatccgttgagcgatggcatttccactcacataccaccggatcactaactccaactttcgttactgctcgacccgtcggtctcgcagttaggctggcttctacgtttacactcactgcacgatttccgtccgtgctgagccaacctttgagcgcctccgttactctttaggaggcgaccgccccagtcaaactgcccgcctaacagtgtcccccgaccggattcacggccgcaggttagaaattcagcaatccaagagtggtatcccaccggcggctccacaagagctgacgcccctgcttccaagcctcccacctatcctgtacatgggttaccgaattccagtattaagctgcagtaaagctccatggggtctttccgtctagttgcgggtaactggtatcttcaccagtactacaatttcgccgggcgggctgttgagacagtgcccaaatcattacgcctttcgtgcgggtcagaacttacctgacaaggaatttcgctaccttaggaccgttatagttacggccgccgtttaccggggcttcaattcaatgcttcgcttgcgctgacatctcctcttaaccttccggcaccgggcaggcgtcagcccatatacgtcatctttcgatttagcatagacctgtgtttttggtaaacagttgcttgggccttttcactgcggcctcttgcgaggctccccttattccgaagttacggggtcaacttgccgagttccttaacaacccttctcccgttggccttaggattctctcctcatctacctgtgtcggtttgcggtacgggcaccttagtatccatcagagcttttctcgcctctcagcatcgcggacttcgctactatattttcgctccctttcgcccgggtcaaccaacgcccgggttccgctatccaaaagtgtccctctgacttaaagttcggtggctacggaatttctaccgtatgtgcatcgactacgcctttcggcctcgccttagctcccggcttaccttgggcggacgaaccttccccaagaaaccttagattttcggccattatgattcccacataattctcgctactcattccggcattctcacttccatgcagtccaccgctgcttccgctgcgacttcaccccacatggaacgctcccctaccactgtcttacgacaatcctaagcttcggttagatgcttagccccgttacattttccgcgcagagtcactcgaccagtgagctattacgcactcttttaatgagtggctgcttctaagccaacatcctggttgttttcgcaactccacatcgttttccacttagcatctattcgggaccttagctgtaggtctgggctgtttcccttttgacaatgaaacttatctcacactgtctgactgctatgcatcaattagccggcattcttagtttgataggcgttggtaaccttatcggccccgctaccattcagtgctttacctccggtaatctaacataacgctagccctaaagctatttcggggagaaccagctatctccgagttcgattggaatttcaccgctacccacaagtcatccgccaccattgcaacgggggtcggttcggtcctccatggggtttcacccccacttcaacctgctcatgggtaggtcacccggtttcgggtctatggcaacgaactttacgccctattcagactcgctctcgcttcgcctccggcactgaatgccttaagctcgctcgttactataactcgccggaccgttctacaaaaagtacgccatcacacgttaacgtgctttgacagcttgtaagcacaaggtttcaggttctctttcactcccctcccggggtccttttcacctttccctcacggtactgctcctctatcggtcatcaggtagtatttaggcttggagggtggtcccccctgtttcccacggggtttcacgtgtcccgcggtactctggattcagtcgcacggccttctctttcggatacggggctctcaccctctatggcgggccttcccagacccttctcctagataacttccgctaaatgactgtccgcaaccccgaggaataaatccctcggtttggcctcttccgcgttcgctcgccactacttgcggaatctcggttgatgtctcttcctcgccctacttagatgtttcagttcaggcggttcccttcctacgcctattttgttcaacgcaggatgactggatattgtccagccgggttgccccattcggatatccccggatcaatggatatttgctcctccccgaggcttttcgcagcttgtcacgtccttcttcggctcctgatgccaaggcattccccttgcgctctttccagcttgacctatcgccgttctcacagcgacttgtcagagaattcttggttctctttgagaattatgcaggctttacaaagatcgaaattgtatgtcaccctgcatcctttcggatgctgttccacaatcaatttgtttcctctgtgtctccacagagaaacctctctgttgccttacttgcttttgtcacattgttcagttttcaaggtgcagatcgccgtccgcaagctttcgcttgtctccggcacagcttccaaccgcttttgcagtcagatttgaagatccgatctttcgatcaggtcttcaaatccaaaggcaaatcgcctggtgggcccgagtgggctcgaaccaccgaccttacgattatcagtcgtacgctctagccagctgagctacgggccctcgtcttggacgaggtgacgctttattctcttggtggagatagtcgggttcgaaccggcgacctcctgcttgcaaggcaggcgctctcccagctgagctatatccccttctatctcccggcgtacgccctctaaattaaacaacgtaactctttttccgctccagctgaccaggaattccaggcagagcttgctctgcccaggtctccttagaaaggaggtgatccagccgcaccttccgatacggctaccttgttacgacttcaccccaattatcgaacccaccttcggccgcgccctccttgcggttaggctacggacttcgggtgttcccgactctcatggtgtgacgggcggtgtgtacaaggcccgggaacgtattcaccgcggcatgctgatccgcgattactagcgattccgacttcacgcaggcgggttgcagcctgcgatccgaactgggacggcttttgggggtttgctctgcctcgcggctttgcctccctctgttgaccgccattgtattacgtgtgtagcccaggacataaggggcatgatgatttgacgtcgtccccaccttcctccgttttgtcaacggcagtctcgctagagtgctcttgcgtagcaactaacaataggggttgcgctcgttgcgggacttaacccaacatctcacgacacgagctgacgacaaccatgcaccacctgtctctactttccccgaagggcacctaatgtatctctacttcgttagtaggatgtcaagccctggtaaggttcttcgcgttgcttcgaattaaaccacataatccaccgcttgtgcgggcccccgtcaattcctttgagtttcaaccttgcgatcgtactccccaggtgggatacttattgtgttaactgcggcacgcagggggtcagtccccgcacacctagtatccatcgtttacagcgtggactaccagggtatctaatcctgtttgctccccacgctttcgcgcctcaccgtcagttgccgtccagttatccgccttcgccactggtgttcttccttatatctacgcatttcaccgctacacaaggaattccgataacctctccggtactcaagacctacagtttcaaatgcagtttggaggttaagcctccagatttcacatctgacttgccggcccggctgcacgccctttacacccagtaaatccggacaacgcttgccacctacgtattaccgcggctgctggcacgtagttagccgtggcttattcgtcaggtaccgtcttctactcttccctgacaaaagaagtttacaacccgaaagccttcttccttcacgcggcgttgctgggtcagacttgcgtccattgcccaatattccccactgctgcctcccgtaggagtctgggccgtatctcagtcccaatgtggccggtcaacctctcagtccggctactgatcgtcgccatggtgggccgttaccccaccatctagctaatcagacgcgaggccatcttccagcgataaaatctttgacatgcccgggatgccccggtcatgcgtcatgcggtattagcagtcgtttccaactgttgtccccctctggaaggcaggttcctcacgcgttactcaccagtccgccactaagcattcctatcatttggccgaaacctcagtcaagggtgctccgttcgacttgcatgtgttaagcacgccgccagcgttcgtcctgagccaggatcaaactctctataaaatggtatctaaacgaaccgtagtccgttcaaaccttcatagagctatttgtcatagcttcatttctccatctcaccggtaattgactcaacccagtgagatgactttgtcctttggcaaactcacctaaatgagctcgccttctggtgcttccttttcgttacgttgtttaatttacaaggtgcacgccgttcccggcggaacattgctattatactcgatttcatttcgtttgtcaagaacttttttcagaagttttttgacatccgatccatctcgtatcagcagcaacctgtttaggttaccacatctcagccttgctgtcaagaacttttttcatttcttcccggcccggctcatcaccgcgccgacagctttgttagaataccaaatccttccccttttgtcaatacctttttcgaggtttttttatttttctgattgctgtggcgatttctccggctttcgtcccctttccccttgcgcaggttgggaaaataagctgtgcaaacggaggcgacagtggtataatgtccatggaaataaaatgtatacatagtaggagggattgatctgcggattcatcgcatgaccgccaccttcggcaaactccagggccggtctttggagctgggggacggtctgaatatcatcgaagcccccaacgagactggaaagtccacctggtgcgcctttctgctctctattttatatggtgtcaacagccgggagcgggaccgcgctggttttatcgcggataaaaaccgctttgctccctggtcaggcgcggccatgtccggccggatggactgcggcacggaactgggggagttgactctgacccgcgccacccggcggcagaccagccccatgggggaattcagtgccgtatacgccggtaccaacgagcctgtgccgggcctgaccggtgccgcctgcggcgagaccctgctgggcatcagccgggaggtctttgagcgcagcgcctttatccggcagaataacctgcccatcagccaggacgccgagctggaacggcgcatcgcggccttgatctcctccggagaggagggcacctcctatacagaggctgcggatgccctgaaaaagcagctgaatcgtcgccgccataacaggaccgggcagctccccgctctggagacggagctggccgaactggaccgtcagctgtcggagagcaactctctggcccggcagctggtgcaggcccgctccgaggtcgaagctctgtcccgtcgggcggagatcctacaggcggaactgacggactgcaaccgctgggaggccgcccagcgccgccaggccctctccggtgccgcatcggcggcggaacaggcagaggtccgcgccgcgcaggtgcaggagcggcttcagcaggaccaaatcccggagaacgagaccatcgcccggctccgcggcgccatcgtcaatctggagaccacccggagagccgtggacaaggcccggtcggagcgggacgaggccatgaaggcattgctgcgggcggaggccgctgtgaatgagagtccctttgccgggcagagtccggagagcgcccggcgagaggccgcaggaactgagaacgagcctgtcaaatggaatccggtccccggcgtgctgacttttttaattggtgtcccactgtgtttcgtcgtgacctatgcggtactttttctcacaggcagccacagcaagctgcttgcgcttctcaccatgctagccggattctcctgcgtgtgcgccctcgctctctttttgaaaaagcgggcgtttcaggccggctgggcagaactccggttgaagcgcttcggcaccgcggacctggatgccatccgccagctggctgaggattacgccaagctgtgcgaggcccgggacgccgcccaggccagtgtcaacgccaagtccgccgcagcggacaccttatatagtagtctctcctccaacgaacagggcatcctgctggaggtccggcgcttcgctcccgacgccttcgacatccccacggcggaccagctgctccgggcctgtgccgtccggcggaaggagctggcggaggcggagaccgccgcccgggaggcacggatgcgctatgagcttcaggtccagcaggcgcccgctcccggcacgccggaggcggatgtccccgctcccgtccggagccgggaggccatctccacggagctggaccgggtccgcgccgcactggcggaggcccgctcctccgcggaccgtctggacggccagctccacgccgcgggcgatcccgcggtgctgcgggcttctgccgaggacctggctgcccgaaaggagcggctggaaacggagtacagcgctctccggctggctatggaggcactggagggggccaacaccgccctgcagaaccgcttctctcccgctctgggccgccgggcagcggagatcttttcccgactgaccgacaaccactatgccggtgtggtgctggaccggagcttccgcctctcggcagagcctgtgggagacccggtgttccgggatgccgccctgctctccgccggcgcgctggaccagctgtatctggcggtgcgcctggccatctgtgagctggtgctgccgccggagaagcaggtgcccatcgtgctggacgacgccctggccaattttgacgacagccgctgcgctgcggccctgcagtttttgaaagaggccgccgggaaccggcagatcctgctcttcacctgccacagccgggagggggaattttttgccggagacagggaagttttcgtccagcggttgacggatgcggcggtagaggtataagatatggaatactccccgttccccgcagcggcggggccgggagcctgtgtttatcaattacgcgaaagcgaaaaaaggagatatccatactatgagcgaatgcacccacgactgctccacctgcggcgagagctgcagcgagcggcaggaaccccagtccctgctgaaggagcaccatcccgaagcccacatcggtaaggtgttcggcatcgtgtccggcaagggcggcgtcggaaagtccatggtcaccagccagctggcggtcaccatgcgccgccggggccatcaggtcggcattctggatgccgacgtcaccggtccctccatccccaaggccttcggcatccacggccaggccacaggcagcgaggcgggcctgtatcccatggtgtccaaaaccggcattcaggtgatgagcaccaacctgctgctgcccaacgagacggacccggtcatctggcggggcccggtcatctccggcgtggtccagcagttctggaccgacgtgctgtggaactgcgactacctgttcgtggatatgccgccgggaaccggcgatgtgtccctcagtgtgttccagtccattcccctggacggcattgtgatcgtggcctctccccaggagctggtgagcatggtggtggagaaggccgtgaagatggcagagatgatggaggtccccatcgtgggcctggtggagaacatgagctatgtcacctgcccggactgcgggaagcagatccatctcttcggccagggcaaaactgccgaagctgcggagcgccaccatcttcccgtgctggcggagatgcccatcgacccggccctggccgcccttaccgacgccggagacatcgagtccttccagggcagctggctggaggctgccgccgacaagctggaggggaaataatgcccaacgccgcgccgtgtccttccacggcgcggcgtttgccgcgttttgtccgtcctatgcaaatccaccggaggaagcaccttctttttgtgggcaaaaacagttgcaaaatccggcaggattcgagataatagaaaaagatcaaatttggcataaaaccatgcaaaatacagacagatcgagggggaatcacccatgcaggaactgaaagaccgcatcgtgaaagagggcaaggtgctgcccggcaacatcatcaaggtggatggttttctgaaccaccgcatcgacacggagctgatggaccatatcgcagaggagttcggcaaacacttcaatatggacgaggtcaccatgatcctcaccgccgaggccagcggcatcgccctgtccgccatcgtggcccaccacttccacaagcccatgatcttcgccaagaaggccaagagcgacaacatcgagggcggcctgtaccagagcgacatcttctcctacacctataagaaaaaggtgacgctgctggtttccaaggagtggctctccgccgacgacaaggtcctgattatcgacgacttcatggccaacggcgaagccatgcggggcctgtgcgacatcgtcaacgccgccggtgccacgctggtgggcatcggctgcgcggtagaaaagggattccagggcggcggcgaccggctgcgggccgcgggtgtgaacctgaagtccctggccatcatcgagtccgccgagcccggcaacatcgtcttccggggcgaggactgatcctctgcattttccgcggcactctgtaagattcgtctcttttttccgtctgataggatagcggaacgatcgttccctatcttccggcgcatcagaaaaaggaggacttttccatgaaacggcccccactgtttctggtactgctgaccctggccctagcgctgctccccagctgtacgccgccgggaggcggagccgacgcaaagccggtcatctacctctatccggaggcggagaccgatgtcaccgttaccctggactatgacggggaactgacctgtgtttatcccgtcatgaatggaaattcctggatggtcaccgccagccccgacgggacgctgacggacgcggtcggtcagacctacaattacctctactgggagggcgtcagccggacggaatatgacttctcccagggcttctgcgtaccaggcagggacaccgccgcctttttggaggacaccctggccactctgggtctgaaccgccgggaggccaacgagtttattgtctactggctgccccacatggaggggaacgcctataatctgatcgccttccagacaagttcctacacggaccatgcccggctcacggcagacccggcgccggacacggtgctgcgggtcttcatggcctggaagccgctggaccgctccgtggagcttccgccccagacactggccgccccggtgcgtaccggcttcaccctggtggagtggggcggcgcagagatctcataaaccgaatttacacaaaggaggaattcccttgtctcaccagactgtcatcgtgctggacttcggcggacagtacaatcagctcattgcccgccgggtccgggagtgcggcgtctactgcgaggtaaagccctacaccaccccgctggcggacatccgcgccatgaatcccatcggcatcatctttaccggtggccccaacagcgtgtatgatcccaaatccccccaggtggacccggccattttcacctggggcgtgcccatcctgggcatctgctacggctgtcagctgatggcccataacctgggcggccgggttaccgaggcccaggacgactccgcccgggagtacggcaagaccgagacgtatttcgattcggcctgcaagctcttcaagggccttcccgcccagggcatcacctggatgagtcacggggactacatggagaaggtgccggagggcttcgctctggtggcccactccgacgcctgccccaatgtggccatctgcgatgagagccgcggcttctacggcgtccagtaccacccggaggtcaatcatacggagcatggcaccgacatgatccgcaacttcctgtatgaggtctgcggcgcagcgggcgactggaccatgggcgactacaaggagactgccatccgccagatccgggagaaggtgggggacggcaaggtgctgctggccctgtccggcggcgtggactcctccgtggcggcagccctggtagccgaggccgtaggcagccagctgacctgcgtgtttgtggaccacggcctcatgcgcctgaacgagggcgacgaggtggaggaggccttcaaaaagtgggatatcaacttcgtccgggccaacgcggaggagctgttcctctccaaactctccggcgtcagcgagccggagcgcaagcggaagatcatcggggaggaattcatccgtgtctttgaggcggaggccaaaaagatcggccaggtggattacctggtccagggcaccatctatcccgatgtgatcgagtccggcaccggcgacgccgccgtcatcaagagccaccacaacgtgggcggcctgccggactatgtggacttcaaggagatcatcgaacccctgcggatgctcttcaaggacgaggtccgtcagcttggtcgggagctgggcctgccggagtatctggtcatgcgccagcctttcccgggcccgggccttgccatccgggtcatcggcgaggtgacgaaggacaaactggacactctgcgcctggcagacttcattttccgggacgagatcgctaaggcccatctggagggcaccatgaaccagtatttcgcggtgctcaccaacatgcgttccgtgggcgttatgggtgacggccggacctatgactacactctggctctccgctctgtcaccaccacagacttcatgaccgccgactggacccgtattccctacgaggtgctggaccggatcagcgtgcggattgtcaacgaagtgccccatatcaaccggattgtgtacgatatcacgtccaagccgcccgctacgatcgagtgggaatgagaaaaaagtgaatatgatgggctgaaaagccttgaaaacactcactttttgaaaatctcatttcctgtttgatagcaaaatgatagcagataccaaagccattttgtttgttcttattgtggcgagcgaatggtttgcaggtttgctgtcgcatccaatcctatattgagagcgaaaaaggctctgctgactttctgtaaaagaaggtcggcagagccttttgttattcttcgttatgttccttgagatcagcaaggagcagatcactcagctcctgcgacggcataatcttgtgccactgaccggaggtgtcaagctcagggtagcggtagcgccagcggtcgtattcttctttggtaatctcccccgctttcagcttggcagcaagcgcgccccatgcggaaagcatcctgtgaagctccgctgcgtcgcgtcctttgtggatatgaacgcgcagatgcacctcatcctcacactcgcagacctcaagcccgtaacggtcttccagcgtgaacagcgtgtgcatcagtcctgtataggagtcaatgtccggtacgtccagtgccttgggcgaaacgtcaagcacctgtgccagcgcagcggtcacgtccgctttaggcgttctggaaccattctcgtactgcgcaaggcggacatctgcggatttctccgggaaacccagcgccatgccaaggtatttctgcgtcatgccccgcatcgtgcggaaaaagtggatgcgttcaccaatcgccataatagccatctcctgtgtcggttatctttgataaagagtatagcagatatgtttaatttcgtcaagaaaaatctaagcaaatttatttaatattttcctgcaaaccggcttgacttaaaccaatatgtatagtacaatggctgtaagctaagcatattagcttaattcatagaaattttacaattaggatagtcaacaaatgcagaaaaaatgtccgttgtaaggtgagaggggggtgaaatccaaaagagccaaactgaatgaccgtccaagggatactttctccggggaagcacgcgatgagacgagcgtgccaaggagaaaagaaaacggcacagcgccgaaaagggttgcctgtcagagtcctgcggatagaacggcagaagaaatcaaccacaaatcaggaaaggaaggtattttgcctatggcaggagaaatttttatgagagtaaatgaagttgcggaagagcttggcgtatcggttccgtatgcgtataagctcattcgtgagttgaacaaagagctgcgaaagaccggctgcatcaccattgcaggcaggattgaccgcaagttcttccatgagaagttctacggaacgagagaaccgaaggaaagaagggaatcgaatggcagcgtttaaggacaagaagaacggctcatggtatgtgcagtttcgctataccgactggcgcggtgagcgccagcagaaattgaagcgcggctttgccacgaaaaaagaggcgcaggcatgggaacgcgagtttctgatgcagaagcaggctgacatcaatatgagcttcgaaagctttgtggcgctctatgaaaaggacgtcaagcccaagctgaagctcaacacatggctcagcaaggagcatatcatccgcacaaagattctgccgtattttaaaaagcgcaagctctcggaaatcaccgcccgtgatgtgatcgactggcagaacgagatacggcagcacaccaagtcaagcggcgaaagctattccccggactatctcaagaacgtccatacccaactgagctgtattttcaaccacgccatcaagtattacggcttacagatcaatcccgctgcaaaggccggaaatatgggcagcgagcagccgaaggaaatgctgttctggacgaaagaagaatacctaaaattcatcgacgccatgatggacaagcctatgctgtactacgcttttgaaatcctgtactggtgtggcatccgcgagggcgagctgctggcactgacgcctgcggactttgatttcgagaagaaaacgctccgcatcaataaatcctatcagcgcttacagggcaaggacgttatcaccacgccgaaaacgaagaaaagcaaccgcgtgatccagatgcctgactttctctgtgatgagatacaggactacttcaaggaactttatggactggaaccggacagccgtatttttccgctgtccaaatatgccttgaagcgcggcatggagttcgggtgcaaggcgtctggtgtcaagatcatcagaatccacgatttgagacacagccatgtttctttacttatcaacatgggctattctgccgttgccatcggcaatcgcgtggggcacgaaagcgtggagatcacctatcggtacgcgcaccttttcccaaccgtacagaaggaaatggcagataaattgaacgtcgaaaggagtaattaaaaatgtcactgaaaaaccgggataaccacaaccgctggcgcaacaagactgttgccttccgggtatcaccggaggaagaccaacaaatcgaaaccttcgtcaagctctccgggctgaccaagcaggactacatcacacgccgtttgacctgcaaggatgtagtggtgcagggcaatccgagggtttacaaagcactgcgcgaccagcttgccgccgtgctggatgagctgcggcgtattaagacgggcggcagcgtaaatgacgagctgctggatgtgatcgaaatgatcgccgccatcatggacggcatgaaagaggaaaatgcctatggaaaatgaaatctgcaaaaagaaaacgaccgccccggacacatctgttggcgcagatgatgggcagccgcttcacaattcaactgagaacagtatatccgcttttgaagaagaaatcaacggtgattttcaaagcagtgcggaaagtcttgacgaaatctatcgcaggattcagcggttaaccgacccgcattacctgcacacaatctccatgaccgaactgtaccagaccgcatatcagagcagaccgccgatcatcgacggcttgctctatgcgggtgcgtacatcctcgcaggtgcgccaaagatcggcaaatcatttctggtggcgcagatcgcctatcatgtcagcacgggcgaagctctatggggctgcgaagtccatcccggcacggtgctgtacctcgcattagaagatgactttcagcgcattcagagtcgaatgtttatgatgtacggcgtcaacgacaccgaccggctgcactttgcaactgcggcgggcaagatcggaaacggactggacgaacagcttgagaattttgtgcgcgagcatcacgataccaaactcattatcattgacaccatgcagaaaatccgggaagtcggcggcgaggcgtacagctacgccagcgattatgagatcatcggtcggctcaagcagtttgccgacaagcactgcatctgcgttttgaccgtccaccacactcgcaagcagcctgccggtgacagcttcgaaatgatctccggtacgacagggttgctcggctgcgcggacgggtcgcttctcatgcagaagaaaaagcgcacggcattggaggcaaccatcgacgtcgtggggcgcgaccagcaggatcagattctctatctgaaaaaggatgccgacacgcagatctggaatcttgaaaaggtagaaaacgagctgcacaaagagccgcccgatcatgttctggatgctgtcgctggactactatccgcagaacatccaatctggacaggatcgccctctgcgcttgccgatgccgtccatgtcggcatggcggcaaatgcgctgagcaagtatctgaatgtgaagtctggcagactgttggatgaataccacgtccgctatgagaacaaggttcggcacgaagggcgacgtatcacgctgacctatgatgctgaaagcaaataagccgcgcgacggctgcgacggttgcgacggtgaaaatgataccgtaaaacaaccgtcgcaatcgttgcgaccgtcgcggagggaagccggcagcacgaccttccgcgcccccgtccccatcgaaaaatccgcagagtttgagatggatgtgggcaggagattatgagcagaggttgtctgcaaataagctgctgaccacgccggtttttgcggtttgtatccacactgcaaaccgcaaaaccggcagagacttccgcagaagccgcataccccctcggagagcccacgatactttgcagccgcaggatgaaagtatcatagtgggttattacacttccgcagaagtgcctccccgaaagctacccgtcctgcacaatctgaaatcaggaggtaaactgcctatggcaagaggcgacggtatccaccgtaccagcgcaagaaacgcaagaatgaaagatacagacatcgacaacgcacaggcgcataatgagcgcgaaaaatcgtcgtatgtcaatcaggacatcgttcctgaacggacgccatacaacgtccatttcaaaacgccaaccgccgggtataaggagatgttcgagcagatgcgctctgacggcgtgatctcaacacgcggtctgaaagcggatgctgagaaattcggagagctgatcttcgacgtcaactccgcctactttttcaaccacggcggctatgactttgcaaaacaattttacgccgatgcctacaaagctgcaatcagaattgtgggcggcgagcaatacatcctatcggcggtcatgcacgctgacgagcgcaaccgcgccatgtccgacgcgctgggacaagacgtgtatcactaccaccttcatgtggtctatcttcccgtcgtagaaaagcaaatcctgtggtcgaagcgctgcaaggatgagtcgcttcgcggcacggtcaaggagataatccagcaggtcagcatgagtaagaagtgggcttccaagcccgcgctggacgagaacggcacgccgattctgagcgccaagggcaagcctgttctcaaaaatcctacagcgttttgcaggacgatttcttccggtatatgcgcgacgccgggtacgacgatgtggagcgcggcgaacgcggcagctccgaggaacacctgacggtgacgcagttcaaggtgcagcaggagcaggcgcggctggcagaactcacagagcagaaccgccagcaggaacagcaggcggcgacgctcggcagacagattgagaaaattcagaatcagcaggtcaatgtggcagctatcgaaaagattgaggcgaagtccgtcccgctgtcctctaaggtaatattggagcgttctgactacgaatcgctggcaaaggcagcaaagaaatacgctgcgtcagagaaaaaggaatccaagttgcaaaaggctttggatgcggcaaacaggctgattgcaaaactcaaggcagagatcgccggtttgaaacaggagctttccgagtacaaatctgttcgcagcaagctccgcacatcggatctggaacgcgaaaacgcagaacttcgcggaaaagtgcaacgctatgagaacgtgatccagcgcaataacctctggcatttcttccgtccacgcagagaaaaaacggcaatgcgggacgatgcccgctgatgccgtgttgagcggagaaaaaccgattttatcaaatgggagcgtccgaatcgagcagcgtatcatttgggcgctccctattcaaaaatcaaccgctttttgcaggtgtagagctgacaaaaaatcttgaaaatgcacctgttttcgcggggcaggcagaaatggaggcaatatgaaaaccggactgaccaaacggcagaaaacgacctgcatctattttgacgaagccagcaaaaccgttgaaatccagacgcacaataccgcgctcaaaaagcggctgacacaatatgcggcggcatatcccaatctgtgcaggcagaccgacgatgacgaacagggcggtctgacctttgagattgaccgcaggcgcttcgctgtccgattgaccgctccgtattcagatgagcgccgtcacgcagcaagcgagcttgccaagaagaatggactgaaaggaagaccacaattatgaattgtagactccagacgcatttaatatttgtactcctatgaaatcatcattaatattgacactattcgtttttgtgagtataatatgatcattaaattacgaaataactggaggaatctatgtatatttcagttaatgatgcggcttcaaaattcaacatatcaaagagacgagttcaagttttgtgtgaacaaggacgtattgacggtgcaaatatggttagcggagtatggctaatacctgatactgcttccaagcctatcgacggtcgaagaaaacatataagttgtaacaaagctgaccagattggtgtcgttcacgacatttttactgttgatgatgtatgtaaggaattgtctatatcaaaagcaactgcaaaaaactggattcgcttgggtaagattgtccctgacattgataaccagtttttcagccgaggatatattgaaagattttcggcagaacttaaaaatcccaaaaataagaagcttaagagccgcagaaacaaaaagtcctccacaggaaaaatcctctacaaagactatattcatactgaaaataataagaggttagtttctgaactattggaactaaatatcattgaagatgaaagggatatggttgcagtacttgcaaattttgccgttcagctttattatcaaagccgaaataagcagtattcagataacaaccttctaatgcgttttttgacgcaaaaacactttgacgatttccatattctaattgaagatttgctaggatcctacaacatagattctgcattatttgaaagattacagcccgcattgacaaaagaaattctttttgtgagcggggaagactcgttaggctttgtatatatttccttacaggatattgcccggcgaaaaagcaggggtgcctattatactcccgaaaaggttgtaaatgagttgattgaaagactatacaaaaatgatgttaatttgaacgcgcgaacgatctgtgatccttgttgtggtaccggtaattttttgctgagacttggtatgatgggaatggactactcaaatctttatggtcaagatatcgaccccataagcatttatatcaccagaatcaatgttgcacttatgacgccccaaatgaccgttaccgatctttattccagattcattatcggtaacacatatttgatgacctttacgcagaaatttgatgttgtgctcggaaatccgccgtgggggagtgaattttctgaagctgatgtaatcacatatcgcaagctttttcaaactgcaaccggtaaaagtctagagtcgtatgacttgtttgtagaaaaagcgctaactatgctcacttacaatggtgtgatggcgtttgttttgcctgaggctattctaagcgtaactgcacatgaagcggtacgaagactaattctcgacacctgttcattcaaatttgttgcctatttaggaaatgtgttttccggcgtacaatgtccctctataattctcggaattatgcccgacgcagctaagacagtccttggctgtgaagtttcaaccggcaatactacttttgtcatttcaaagcatcgcactttctctgacggaaccctctcattcaatgtttctgatgaagaaaatcgttgcttaagtacgattagtgggattgaaaatgcggcttttttgaaagaaaatgcgaaatttgcgcttgggattgtcacgggtaataataaggaatatatatctacagaaaaacaaagtgataatgagttggttctgaaggggagcgatattcaaagatataaagtgtgtccgtctggaaattacatccggtttgagccagaatcttttcagcaagtagctcctatagaaatctaccgtgcaaaagaaaagctactttatcgctttatcagtgaagtacctgtattcacttatgacaataagcaaacactttctttgaacagttgtaatattgttatccccgaaattgatggacttgcaataaagtatgttcttgcaatacttaattcaagcgttgtagccttttttatttcaaagaaattcaactctgtcaaattactccgttcacacatagaacaggtaccaatacccattgtttcagcagaagaacaggacagtattataaaaaaagtagaccgcataatgaactctttcgaaaacattagcggtctatatagcgagttagatgacatgatcatgggtctgtaccatttaacagtacaagacagaaaaatcataacagcggctttggctggtaaaaatctatttatcgatttttgacttgcccttagcataaaccgcatcaagtatgttttcttcttttacaaagaacgggagcaactcatcttctgtcatgaacacttgcccttcaaacactggattatctgccgttcctgtatgttcatttctatgttgcgagcctagtttccctgttttgagaagttcgtcactactcaaaacccaataaagcaacgtatcccgacaagtaccaatccaaatgaatacatcgcaacaagacggttttaactgctgatagtgatatttgaaccccgtatcatgcgcctcggtgtgtaaataggctcggctggctaaacttccactactttttgtactatttgctcgacacgctttaacctcaatcctaataccatccagccaaagatcaaattcgccgtcaaaatcagggtatacgtcggcaaggttttctttcgtagctttgatgaactgcgggaacaattttctaatgtattcttctccccatgtttgaccatatgtgcggggagccatatcaaacagttcgaggaactgattcctattgcagtagtcttcgtcgagcttagcatattcgtcatatgtaatttcaccaagagacatcagatatgctagaattcggctctctctactgaatggatataatgctttttcacgcattatagaagaaatttcctctttcgtacattttgaattgcatagcaattcttcaattttctctcttaactgcttcatgcgtcctcctccgatataagaaatagtttatatggttctacgccaagtgcatctgcaattctctgaatattttctaacgaaatgctcctgcgaaagcattcaatagcactaatgtatgttctgtgcataccgcacttttctgcaaatgcctcctgagataacccggtctgctggcgataccgcttaacatttgatccaaaaaccttgactatatccatacttgtaaacctccatgatatatgctacaatatcgaatacaataagtctacatacaatgagtcgcgagacacaccacatctggaaggacatttatcacgcatcgttgttgtgacagcataaaccatgtcgtatcgtttggcttctcttcgtatattaccgacgatattagcaacatatatctgcaccttatgagttggtttgcgtggccaaaggagttagttttgaaactgctcatgtatgacatgtacacctgattaaaggagaaaaagtacaaatttcaaataatctatggagggattactatggcgttaccgacaagttatatgacagggagtttcacaaaaattcctcagtattttgatacaatgctgacagcaaaagccccagacaaatttacaacaaagttcatggctgatttaggctttaccagttcaaatgacagacaatttgtaaacgtattaaaggcaattggctttttggatgatagtggaaccccaacagaaagatacttcaaatttttggatcaaagcttttcaaaacaaatggttgctgagggaataaaagaagcatacgccgatttgtttgcccttaacacgtctgctaacaaaatgacgaaagcagaggtcgaaggaaaattcaagaccttgactaatggttctaaagaaaatgcaactatcggacatatggcaagcacatttataaatttatgcggatatgcagattgggctgaaacgcaaagctcacctacaccgactcaatctcaaaatgctgatcctgtgcaaagctctgataacggattaacttcaaaggttgcccatcctcacgaaggacacagaattgatttgaattacgatatccacattcatttgcctgcaacacgcgatcaggcagtttatgatgctctatttgcaagtttaaccaaacacttaccgttaaagtaggagatatcggcacatggagacggatttatattcatttgcttttcgaggaatactggcagaagaagcccttgacaaagccggtcacaaaaagtataccgcagaagaagctttcttttctgagtcattggcaaaagaacttcatttcgatgaaatcgacagcaaatatgtcgagcaatcaaaaacaatgataaccgtttttgcgaccataacagcatttgaaaacgcaacacgagaatttgttttctcaacacttgctggggcatatggcgacgattggtgggcaaaaggtgtacaaaacggtattagagagaaagcgcaaagtagaaaagattctgaaaccaaagtcaaatggcatataaatcgtggtgatatgatgatgtcatatttggaatttggtgatttacctaagataatgtgttcgcaggggaattggccttattttgaaccatactttggtttttctaatgctcaagagtggatacgtactacatttgagacaatcgaaaaatcacgaaacgtgataatgcatagcggagtattggacgaattagatgttgctagagtagggatgaatataatagattggttgcatcaaatcaatgcctaactactgtgcagcgtgtaattattgcatatattatgatctggcagaatattctttagataattcttgattgctgatttcttctattgatagcatcccctgatagctttttgatagcagaaagtcggataccccataggattgggataattggtatcaaataaagccaaatggaagcaaacggtctatacaaaaaagtttagagcgcgtttccgcttggcgagtgggaatgacggtcacaagctccagggcctgcgcttgggccctggagcttgtgattcttaaaatcggaacaggagggatcacatggatcaggcaggcgtcgcgctataccaccgtgttatgcggtgggaaaattttgagaaggcggcaaaggatcttgtgtccttggtatacgccgcggaaaagaaggagccgggaaagccgagaaccctgtaccttgacattgacggacaccgcaatgcgcagggcaggtttgacgcggatatgcggagctccaaaagggattcggattgagatttctgcttccgtttcttacggaagttcatttcccactgatttctgacaggaacaagaacccacagcggaatgatgtgcccgaacggctggaaatttcccacgccagaaatgagaaggaccacagcctagacgccccgtatgtggagaatttcagccacaccgaatatcagtccgaggcgactgtatacgcctatctcaaacaggtctcggattttttgaagcgctaccaagagctggacgcagagtatgcgctgctgcccccagagccctatgacccgcaaaactatctgctccagtggcgtcttcacatgcgcgagctgatcaacgagctcttcaacatgtttgtgggcgggaatctgttttccacagcggcgatgacgcggactctgatggagtgctgtgtctacgggaaagtgctgaagcaggaaaagagcgcccgccttttggaagactggtttctctgcgggatgatccgcagcctccccggccaggatggggcgctgcggcaggcaaaactcaaaactgtgtatgcactttgcagcgcatggaaccgagagccggaggaaacaatccggcggttcaaaaagggcaacgaaaacgagtggctggtttccgtgatcccgggcaaaggccggatctacttctcccatgtttgtgaatacctgcaggaaacggagctctatcagacgtatcaatgggcctgcgcgtttgtccacgggcaggatatccgctccaaaatgcatcccttcacattttacgactccacctatcatctgctcactgtgatgatgtcttatatcttcagggcgatccgcctgtaccctgtctctgaggagctggaggcggagatgcagaagctcgaacgggacctggctgctctttggggaaccaccagctgggacaaaaacgcatgacgggcttacgaggcggctgtacaggttgccgcggcgctgatggtgccctgccaaaagcatccaaaattcaaaaagagagacatctactttccgcagatgtctctctttcgagaagggacggtcaaaatcgatattttaaaatctcgaaaaggtataggagacccaccccaccggccttctggccggcggcgcatttgcgccgcacgggcgctttgccgtagataaaacctcggcgcaggcggaattcacttccgccgagcatttgaatcaccgaagggcgggggccgccttcggctgccggagcccaaagagaaaggacttccggataggaagccctttctctttggtgcgcgaggcgggacttgaacccgcacgtccgtaatggacactagaacctgaatctagcgagtctgccaattccaccactcgcgcgtcgatatgaactttgctccctgtatctccccgttggggtgttccaccggaagggagccctccggtggaacgtggtgcgcgaggcgggacttgaacccgcacgtccgtaatggacactagaacctgaatctagcgagtctgccaattccaccactcgcgcatagagcggttatcttttcagagacaccgtatggtgcggctgacgggatttgaacccacacgtcgattcggacaccagcacctcaagctggcctgtctaccagttccagcacagccgcaaatgttcgtcccctaaaaaagactgcttgattattatagccagtcgagatccaaatgtcaactgtttttccccgatcagtcgaaaaaatttccatggaccaggaattcggccgggaccgccgaagacggtcccggccgcctgacctgttcagcgccggtccatggacgtatagggacggtgctcctccacacactcataccgggggcggatcagcttgcctcccacggagagctcctccatccggtgggcactccagccggcgatacgggccacggcgaacaggggcgtatacagctccttgggcaggcccagcatctcatagacaaatccgctgtaaaagtcgatgttggtggagagcacagacttgtgctgccgctccatcagcagctgcttgccgatcttctccacattggcgtacagggccagctcgtcctcccggcccttttccgccgccaggtgattcacgtaggcccggaacacctcgcaccgggggtcggtcttggtatagaccgcgtggcccaggccgtagatcaggccgctgcggtcgaaggcatccttgttcaggatcctggtgagatagtccgccacgcagccctcgtcattccagtcccgcacgtgctccttcacgtcgtccatcatggccatcaccttgctgttggcgccgccgtggcggggacccttcaacgaggccatggacgcggcgatggcagaataggtatctgttccggaggaggtgaccacatggttggtgaaggtggagttgttgccgccgccgttgtccgcgtggaggatcagggccacgtccagggtccgggcctccagatcggtgtagctgcagtcctcccgcagcatccgcaggaagttctccgcggtggacagctccggcttgggcacgtggataaacaggctctccccctgactgaaccgccaggcctgataggcgtagatggccagcacgggcatattgctcatcagctgcaggcactggcgcagcacattctccagcccgatgtcgttgggcttgtcatcatagcagaacagcgtcaggatgccccgctgcatggtgttcatcagatcccggggcggcgccttcataatcacgtcccggaagaaattggtgggcagcgtccggtaggaggccagctgctggcagaatgcctccagttgggcggcggtgggcagttcgccgaagagcagcagataggccgtctcttcaaaggcgaagcggcgcccctcggagcccttcaccagctcccggcaatcgatgccccggtagtaaagcataccgtcctgggggatgatgtgctccccctccgtgacgctgtaagactggatctcgcccacccgggtcaggccggtgagcacgccgcggccgtcctcgtcccgcaggccgcgcttgacgttatactccttatagagcttggggtcgatgtagtttttcttctcccactgttccttcagcgcgagaatggcgggggtgatctcacaataggcgttctcacggttctctttccagaccataggggtgcgcgctcctttcggcggcatgcagccgttgtactatttgcaatagtatcattaaaaaattgcattttcaaccgttttaaaaaatatttttgaaaaaataagaaaacttttgaatttttcttttttcgaacttgcaaattcaaaaagcaacaggcagccctcggagggctgcctgaagaactccggcgccgaagcgcctcacagctgggccagggtctcgccgatggggtcagtaatcaccagatccgcggccagatcccgggccaccggcgacttgttgaggagcaccagcctgtgcccctgatagtatcgaatcagccccgcggcgggatagacgttcagggaggtgccgccgatcatcagcatatccgcctccgccagggcgcggacggctgcctccagcgtcccctgatccagcccctcctcatagagcaccacatccggcttgatgatgccgccgcagctgcaccggggcacgccctccgtgcggaggatatgctccagaccgtaaaatttcccgcaccgctggcagtggttccggtggacgctgccgtggagctccagcacgttccggctgccggcggcctggtggagcccgtcgatgttctgggtgatgacggctttcaaccggccctccgcctcccactccgccagctttttatgggcggcgttgggcttggcgtccggggccagcagcttggcccggtagaagcggaaaaattcttcggggttgctttcgtaaaatgtatggcttaaaatcacttcaggcggatatttccattcttggtgatataggccgccagtgctgcggaagtccgggatgccggactctgtggaaacgccggccccccgaaaaacacgatgttgtcggagctgcccaccagttccttcagccgtttaatactgtccgtcataccggaccctccattccaatttccaattttattgagacaggagcacaggcatgaacattcagatcttcggttcctctaagtccttcgactccaagaaggcggagcgctggttcaaggagcgccgcattaagtaccagtatatcgacctgccctcaaagggattatcccccgggagtaccagtccgtcaagcagaaagtgggctttgacgccctggtgaacacgaaatgccgggcctatgaggacctgtacatggcctatatcaccccggacgcccgggaggagaagctgctggaacacccggagctgttcgtgacccccatcgtccgcaatggaagggaggccacggtgggctaccatccggaaatctggcagacttgggagtgagtctctgccgcccgacagaattctgcaccgctgcggaacagatcggtggtattctgtgcatactatggatgcacacggagaggaggtggcctgcgtgcaaaggcgagcctggatggagctgccccaaaaccgctttctgcggggcatctatctgctggtgcagcggtatctgcgccacaatgtggggatgcagggagcggctctggcgttttacctgctgttcatgatctttcccctgctgatctttgtcagctccctgctgggcctgctgcagctggacgtggatgccattctggccgcggtgcaggagttcctgccccgggagatcgtgtccttcatcggggtgtacctcacctatgtgggccggaaccccagtgtgaagctgctgctgttcggcctgttcttctccctgtacttccccatgcgggccaccaacacgctgatgcgctccgtgcggatcgcctatcacctgggcccgccccggggcgcgctgccccagctggtgaaaacgctgctgtacacggcggtgctgatcgccaccatcgccctgaccctgacgctgatgtccgtgggagaccggctgctgctctacgccgtggacagcttcggcctgccccggttctgggcggtgctgtgggcgaagctgcggttcccggtggcggcggtggcagggtatttcgccctgttcttcctgtacgcactgtctcaggacggccgccagccctggcggaacatctggcccggcactatggcggccctgggggcctggctggcgctgaactggctgtactccacatacgtggagaactttgccgactactccctgctgtacggctccatcggcacggccatcgcccttttgatctggctgtatatgaccgccgtgaccctcatcatgggggcggagctgaacgccacgctgatctccctgcgaaaggaccgggcgggggaatcgtaaacgatttttgaatcccggcggcccccgctttactttacgggagagatgctctacaatattctctgggtgaggaaacccttggaaaggatggaatcaaatggaatccatgaaagaaaaactgacggaatacgcccagctgctggtgcgggtgggcctgaatatccagagggggcagccgctggtgatctcctcgcctgtggagtgcgcctttttcgcccgtctctgtgcggcggaggcctatcaggccggttgccgggaggtggtgatgaactggggcgacgatgaactgggccggatgaagtacctccatgcggctgacgaggtgttcgacaccgtgcccctgtggcggcggcacttctacaacgactacgccctggagggggcggcgtacctggccatctccgccagcgatccggagaacctcaagggcgtggaccacagccggatcgtccgggcccagcaggccagcgggagggccttgaaggacttcgaccgtctccagatgtgcggcggcttcccctggtgcatcgcctccatccccatccccagctgggcgaagaaggtgttcccggatcttgcggagagcgaggcaatggacaaactgtgggaggccatcttccaggcagtgcgcattaccggcgacggcaggtgcgtagacaagtggcaccggcatatcgagaccctggcccatcgggtggagaagctgaaccagctgaacttcaagtccctccactacaccaactccctgggcacggacctgactgtggaactgccggaggaccacatctgggaggcgggtaacgacgtgactctgtctggccgcacctatatcgccaatatccccacggaggaggtcttcacctctcccctgaagaccggcgtcaacggcgtggtctactccgccctgcccctgtcccacaacggcaccatcattgacaagttccactttgtggtgaaggacgggaagatcgtggaggttcacgcggaacagggggaggaggccctcaaggccgccgtcactgtggatgaaggggccagctacttcggcgaggtggccctggtgccctatgacagccctatctccaaccagaagatcctgttctacaacaccctgttcgacgagaatgcggcctgccacatcgccttcggcgaggcctatccctgcctcaaggacggccaggccatgagcaaggacgagctgaaggcccggggcctcaacgactccatcacccacgtggacttcatggtgggcacgccggacctgaacatcctgggtattacccacgacggaaaggaaatcccagtgttcgtggacggcaacttcgccccggagatctgaaatcagagagaaagaggagagaccatgacatacgagctgagaaagactgacgagaacgtgctgattgcggagggcgcctccgtcaccggagacgtgcggctggcaaagggcgtcagcatctggtacggtgcggtcctgcgggggacatgggccccatcaccgtgggaacggacaccaatattcaggacgaggccatcctccacgaggagacggtggtgggcaggggctgcaccatcggccacggggccatcgtccacggctgcacagtgggggacaacaccctgatcggcatgggggccattgtcctcaacggcgcgaagatcggcagcgactgtatcgtgggtgccggggccctggtcaccggaaaaatggacgccccggacgggtccatgatcctgggcagccccgccaaggtggtgcggcccctgaagccggaggagatcgaaggcaaccgggcggccatggaggagtatctggaagctgccgcccagtatcggaaggagcaggaagcccgttgagacaggccctccgggccggaaagagagtttaccgttcatggaatggaacaaacagaagatcaaaggacttctgctggtggtctgcggcggtgtggcgttttactgcgcactgcagcgcctggatgcagtcctggcggcgctgggctggctgcttgggattttggcgccgtttctgctgggcggcgccctggcctttatcctgaatgtgcccatgcgggccatcgagcggcacctgttccccagaaaccggaagggcgcaaagctccgccgccccctggccctggtgctgaccctggtcgcggtgatcggtgtgctggccctggctggcctggtgatcggcccgggcatcgcagatgcagtcatgtccatcattcgggagattcctgccgccttccagcgactggagcaccagctcaccgccctggcggagaacctgcaggacctgtggcctctactggaggagcagctgatgaagctgcaggaggagatccaatggcaggagctttctgccaaggctctggagatcgccaaggcaattggggccgggattgtctcctccggtgggttcatcggcggtgtggtcagcggtgtcagcacctttgtcatcagcctgatcttctccttctatgtcctgctgcagaaggagaagctgggccgccagggccgccaggtgatttacggcctgctgcccctgcggcaggccgaccggacgctggacgtcctgcggctgtccgggcggaccttctccagcttcctctccggccagtgcctggaggcctgcattctgggcacgctgttcgtcgcggccatgaccatcttccggatgccctacgccctgctggtgggcgtcctgatcgccctgaccgccctgatccccattgtgggggcttttatcggctgcgctgtgggcgcactgctcatcgccatcgacgatccctggaaggcgctgtggttcatcgtgctgttcctggtgctccagcagatcgagggaaacctgatctacccccatgtggtgggttcctccgtggggctgccctccatctgggtgctggccgccgtcactctgggcggcaagctcatggggatcacagggatgctgttcttcatcccgctgtgctccgtgatctacgccctgttccgcagctatgtgaaaaaccggctggtgagcaaggcagtcccaccggagaaatggcgggacccgcctcccccaccctcccggcagtgagcgttctttccgccgccctacatctgttcaaaaaccggccgtccaaattgggcggccggtttttgtgcgcagattcaatttttattgacaagaatccttgtcagtgctatgctatatttgacaagaataattgtcattttgacttggatcattgtcgggaaaggggatgagcggatgccgctgtacaaccggctgaaggagcaccgggcccggctgggggtcaaccagcaggagatgggcgccctggcgggtgtttcccgccagaccatcagccagatcgaacgggggactactccccctcggtgacgctggcgctgaagcttgccaggatctgcggtgtaaccgtggaggacatttttacctatcaggaggatgaatgccatgagcgataacgtgaggcgggacaaccgcagggcgctgcccaaatacctgctgacaattctgctgttcgggctgctgggcggcgtgctgggctttttcaccggtgtggctggggccgctggcgtggcggagacggtgcggcaggccctggaccgggtgctggcggtgtgtgcgccctggggcatcgtcggcagcgccgtggtgctgctgggggcgggctggtacctctatgccgccgccaaacggcgctttgccgcctgggatggggaggacgaggacgccatggacgcggcggagcagcagctgagctgggctctgctgctgacggggctggtgataatcctggactttttcttcttcgccgcctccatcatctacgaccgctttctgccggacctgatcctctttctggcatctgtggcggtgctggtggtgctccagcagaagatcgtggacctggagcgccggatcaatccggagaaacggggcagcgtttacgacatgaaattccagaagacctggatggacagctgcgacgaggcggagcgggcccagatcggccaggcctgctaccgggcctatatggtggggaccaaggtctgcatcttcctgtgggtggccctgctgatcctgaactttgtgtttgacttcggcctgctgcccatcgcggcggtgctggcggtgtggggcgcgatgcaaacagtctatgcccttgagtgcatccgactcagcaagagaacgggggacgcgtaatggacatcgcgctgctgggcgccgttttggcagcctgcgtgctctgcctgttggagaaaaagaaggcgcaaatctgatgccgccgggcatttcacaaagccggcccgcttgtcagcgggccggctttgtggtattctttattttgtttgaaggaatctgcggtccatcccggggcggtccgctccccgatgcccggatttggcggaggtgtttatggtcgaattgctgctgattttagcggcagccgctgctgcggcagctgccctggccgggcttggatacctgctggtctggttcctgctccacggccggcgggatggtcctggctgggaaaagctggagggctttcggtacgcccaccggggcctccacggccccggcgtgccggagaactccctggcggccttccgccgggcggcggaggccggatacggcgccgaactggatgtccatctgacccgggatggacgcctggtggtgatccacgacggggatttggagcggatgtgcggcgttcccggccgggtggcggaaaaaaccgcggaggagcttgccgctctccggctggcaggctcagaggaacacatccctcttctggaggaggtgctccccctgtttgccggacgggcgccgctggtggtggagctgaagaccgaccggcacggcgccgcggcgctggcccgggatacggtggattgcctggaccgcttctccatagactactgtgtggagagctttgacccccggccgctgcggtggctgcgccgccaccggccgtcggtgctgcggggccagctgtcccagaatttccaccgccatccatccggccagggtccctggaaccgcttggcgctgacgaatctcttctacaatgcattcacccggccggattttgtggcctaccggttcggagaccgggaaaagccggcagtgcggctgtgccgcaaatttgggatgcggatggcctactggaccctccgctcccgggccgatgtggcccttgccgagcaagagggcgccctgccgatttttgaagaaccggaccgaccgaaggaggtaacccattgaagtcgacaaagaaagaaaagaagcagtataaaaaggcatttcaggaggccatggcgcgggagctgcgggaacacaaaagctccttcatcgtcttttccatcctgcggattctggtgctggtggtgctggtgcggcagatcatgctggccaactacgagggcgccttcttctgcattctcacgcttctgctgctctacgtgcccagctggatccaggtgaagctgcggatcgagctgccgccgcccctggagatcaccattttctgcttcatctttgcggcagaaattctgggtgaggtcaacgccttttatgtcgtgatccccggatgggacaccatgctccacaccatcaacggcttcctggccgcggcggtaggcttctccatggtgatgctgctgaacgacgatgaccggatcaccttccatctgtccccggcgttcctggccctggtggccttctgcttctccatgactatcggggtcctgtgggagttctttgaattcggcatggacttcttcctgggcacggacatgcagaaggacacggtcatccacgccatccactccgtctccctggatcccacgctctccaacaaggtggtgacgattccggatatccaggacgtggtcatcaacggagagagcctgggactgggcggctacctggatattggcatcatcgacaccatgaaggacctatttgtgaatttcatcggtgccgttgtgttctccctctccggcttcttcttcgcccgcagcaagggccgccggaagagcgccgcccagggctttgtccccagcaaaaagaccgcggagcaggactatctccagcaggcgctggaagaggcggatcaaaaggacgcggacgcccccactccggatggccccccggcgccgggagaaccggagggtgcctgagcgccccacacagacagaaaaccaccggccgaagccggtggtttttcgcagcagcggccggcagatgccggccgctgctttttgatgtgacagggttcagtcgtccagctcctgctctgccttgacaattgcgccggaggaggcgtcgatctcatagctgtactccgtccggcccacatggaactccacctcatacaaggtccggccgtcatcccggtccaactccacctggatgcgggaggcgtcgctctcactgacgccggcgtgggtcaaggcagcggattttgcagccgcctcgccaatgtgggggccggagctgccggatgctgggacactgtggctctcccgctcgcttttcagcacggcaccggtatagaggtcgatctcatactgatactccgtggtgcccgccaggaactccacctcgtagcactccgcccgcccgtcgtcgtgctccacccagcagcggagatagatggtgtccgcttcgctgacgcctgcgtgggtcagggcggcggcagtggcggccgcctcgccgatgtaggagccggagctgccggttgttccgccggagatgccgccctcccgggagaaattcaccacctcaccggtgcgggcattgatgtcgtaatcatactctgtgccgccggcatagaactccacctcgtagaccatcaggccgtcctcgctgtcgaactcgatctccagctgggccacgctgctctcggcgatgcccgcatgagccagggcggcattttgggcctcctctgccgtgatataggcctttgtgctggcggtgcccgtctgggtgacggcctgggtggtcagatgccgggactcggcgatcaaggcgatctcattcaccgacaggggtgccagggacgcaaaggtcagtgtgctgtcctgagcgatcacctcctggatcagggatgccttgcctacggagatgccgtactgctgggccagagcattcagatccgcgctctccgtcactgtctggctgaggacagccccctccagggaaccgccctggaagacgctgttgatggtatccgtcaggtgctgctggagctgggcggattttgcggcgtcctggttctccacggacaccaggatggcgttctggatatcgctgagataaccgttttggagcatggagccgatgagggcgttcactgccacgtccaggtccgtgccggtcagatccatgtcgcccaggataacctctgcgtcctggttgaagggggtgacggagagcacccgctccttggagctgacggtcatggacaggctggggttcacatccagcatcaccacggagtccacggcgttggctccccgccagctgctgatgccgaaagcaccacagcacatgaccaccagggcggcagccactgccaggggcgcccagcggcgcttctttttcggagcctcaaaagggaggacagttcccgcttgcgggccgcaggcggccaggatgcggtccagcggatcaggagcggcgtgctccacggcggtccgcaggcgctgttccagttcacgttcgtccaagtcagtctgcctccttccatgcgagttggagctttttcaaagcccggctgtatttggagagaaccgtggggagcggcaggcccagcagagcggcgatctcccggtgccgcaggcctgtcagcgcgtggagggtgacgatctgccgctcttcgtcactcagggcggagagcacggcctccagcatcatccggtcctcatgggtcacggcgggattgtccgccagacggtcctgccagtcctcctgaaccaggggttccgtccgcccgtgctcccgcaggcggctgatggccagattccgggtgatggtcagcacccaggccataggcttgccctgcctgcggtatccgccggcagcgttccacacctgcaaacaggcgtcgtggagaatatcctctgcgtcgtgggcgtttttgacgattgacagggcaaagccgtagacggcaggacgggtgcggctgtacaaatccgccagagcgtccttgtctcccccggcgatgcgggcgatacagtcctccagggcggcatccgcgtctgggtccggctctgccacggtcatgcagaatatcatggggcttcctcctgttcacacagacaacgcgccggcggcgcgtttgattgcactgcggccgaagcatcaccggccgcgcccccatgatagcacatcctgcagaggtttccaaccccgggccgaaattttccggaagggcagctgctccgccggatcagggcagcatccggtccgccgccgtgatggggcggatggggcggcaggggacgcccgcagccaggactccggcagggatgtccttcgtcaccacgctgccggaggcgatgaccgccccgtctccgatggagacgccgggcatcacgcggacgccgccgccgatccagacgccgctgcccacacggatgggataggcgtactccagcccctgggcccgctttgccgcgtccaaggggtggccggaggtgtagaatccacactgggggccgaccagcacgttgtctccaaaggtcacgccgccggcgtccagaatgacgccgccgtggttcatgtagaagttccggcccacactgatattccagccgtagtcgcaccagaagggcggctcaatccgcagtccttccccagcggcgcccagcagccggcgcagcagcatctgggcggattcgatgccctccgcctgataggcccgctgattgaactgctggcactgagccttgcaggcagccagctccgccagcagggtctcatcacgggcgggtgcgtacagcattccccgcagcatcttctccttttccgtcatagggtgattcctcctgtacaggcggccccagggccgcagttcactctgccattatacagaaggcgccctccgggtgcaagagccgccgtcggttcagccccggggatactggctgctgacgctctccagctctgtgacggagccgaagccgctgatttcgatgtcgtaccacgtgtccccgttgatgatttcgtagctgtactcattccaaaggccctcactactgacctcctgtgagacgatctccccgccgccgacggtatccagcgcgatctgttgagcctccgcactgtccacccgcagcgccagcacagcggccacggccgcgacggccagtaccgcagctgcacccacgatcatggcgacgatcttcttcacagacatgtttttcataaaaagctcctcctgcttgttgtttcggattcatggttcctgtttgtgtcttctgccctgataacgcgcagacaacggcttttattgcatggcgggcgaaattttttcttgacaggatcgcctaaagccgccactgtgagaggcagaaaggaggtgaatttgatgaaatataaaaaatttggaaatatcagccctatcgaaccagtcggcgggagcaagactatcaacaggttcaggaatttctgaaaagcggcgatcccgaactttggaaggcgctttatgagagtgcctatgaaattgtataccagtgcgcgtacgggatggatttttgccgcgtgctgggacctgatgattactgtgagattgccgatgaggcgtttgccctctgttatgaacagctggaccgatatcaggggctcagccagttctccggctgggtaggcgggtacagcaaaaacattacccgcacccgctgtcggcaggtgttgaccggcctacggtatcgccggcagctctatgaagtctccaccggacggatgcgggattgggatcccctgtggatcctgattcgtctagagcggtactattgtctctggaaagccatctccgacatctctgaaacaagccagcggattctggaggctcggattttggaaaagctgtcgctgcgggccattgcgcaggaattaaatctgacacagcgtgaggtaaaaacgcgatatgaagccgcgtgcaatgtggtccggacgcgcttcctgcgctattgcacggagaaagtagagttttaaagtgcaggaatcccaactattcatgccgaaaggagtgcaccaaatatgcacaacgataaaaaagcgtatcaagttgatcggacgccgacagaattgctcagcgatctgctcgtccagttaaaatttttaaggcaggaatgcctccattacgatgcaggagactggtcttacggtgcgcagattgcgaccaagctccggcttttgctccaccagacaaaatattctgattccctgctggcccaaattacaaagcgttttgcattcagctgtccggattttctcagtctgagcaccgtgcggggcgagctgcccaataaagggaggaccgattttgtccgctccccgctcattcagtaccagatgattcaccagccagaagtccctccggttctgacggtgcagcccctgtctctggaacccggaaagcgatatgccaaacgggcattcaagacctggtggaatgggattgacattctcctgattgaccggcagcactttttgaaccgtaagggcgtagtgtgtctgctggcaaaccaggagggcggcgcccatgtccagcccggcatggacgaaaaggcggctatgttacgccggggagcggcaaattccctgcagattgccgccccgctgccggacgggctgacgcggatatataccgccgaaatcgaccaggtactggcagccgttgtgcgcaccattgcggcggagacactgtatacatttgagcatgcaatcctgccccgctgccaaatcgccctttctgcagatgaaaaagactgaagcgggtccgggagccgcgccccggcggcgttgacttttccgctgctttccggtatgcttttgctatcctgatacaaagggggcgccgcgcatgccggacctcacttccctgttcacagacacgctggccaagttctccttccgggcggtcctctccgccgctgccacgctgctgatctgcctggtggccgtccacctgctgggcaagctgctgcggcggctgctggctaggacgaagctggacgagcgcatccagaaatacctgctggccggggtgaagctgatcctctatatcgtcacggtgctgatcgtggcggagagcctgaacattcccatgacctccctggtggcgctgctgtccgtggggtccctgggcgtcaccctagcggcggaggacatcctgggcaatgtggccggcgggctggtgatcctctctgcccaccccttctccatcggggactatgtagaggtcggcggcgtggccggcacggtccatgagatcagtctgaaccacaccaagctggtgaccccggatgggcatttggtgatgctccccaacaaggagctggcctcctcccagatgaccaactacaccgtattggggcggcggcgggtggtgcagcgggtgaccgcctcctacgacgcccccacggagacggtgaaggccgcctgccggcgcgctctggagcagacggaaaacctgctggaggacccggctcccaccgtctacctcaccgcatacaaggagagctctatcgagtacaccgtctactgctgggctacgccggagaactggtggggcgcgtatctggctctgggggagcacctgcgggacgccttccgggagtacggcgtggagatgacctacaaccacctgaatgtccacatcatagaaaaccaaagctgaccgcgggaggcgctccaggcgcctctgtatacagcgacgcccggtccgggaaatcccggaccgggcgccgtcttttggggtaaatgccgcggaatgccctgcatgggacacggatgtggtgggtctccccgctcatgcggttgacttccgcccgcagcgccatcttatcccgctgcgaacgagatggccggcgctcaatacctgcccgcccagtccgccagcagcaacaccggcagcgcccacagcagcaggaacaccagcagggccagaggcgtcagcagattataggcgccttggaacaccatataaaaggacagcagcgtcccggccacgctgcccagcacggacagcgccgtggcccggcgcacagccttgcacaggcggcggctgcctaccaccgcttccgcatagggcagcagtccttcccgaaacagcagggcccggggcatcccccggtccagctccgcctcactgaaagccacccggtccgtcagactggggaactccaccttcacgcccttgtgaaacttccgcttcagcagggccggggtgatgttgggatcccgggacgccaggatcggcgtgatgcggctgcggcgcatcatccgcagggcgaaatccacgttctccgagggctggtacttcacggcaaacactgccgccagctgccggtccatggccaggaagatgccggtccgcaggttgatgccgccgggcaggcgcacctccatcttccgcatgaaggaggccgtgcccagcaataccgactccccccggatggtggcggagtagccgccctcctcataaaagctgaaatcgtccactttctcataatggccgccctcgctgcggagcaggccgtcaaacaaccgctgaaggccgcagtccgccgcccgggccatagaggcggcataggaggaaacccgggacaggtcctccccgaacacctttacgccgttgagctggatcgtacccggcgggaacaggtctccgtccgtcaggatcatggcccgcctgcggctgatcttctccgcaccgcaccagcccgccacggcgcaccccgccttgtgaaagtgccgggccagccgggagaatggcatcccccagcacagaggcagggcaaaggtggtgcctgcccccaggatggcagaccagttcagcaaaaagtcgtccccccgttcctggcccagggagctgagcccggcaaacacgatggaggccatcagcaccaccggcatcagcgcgttctgccacacggcggcggtattctcccgcagggcggtggtgtagaagccggggacggaacccgcctgcttgcaggcccccttctccgtctccgtcaccagataaggcggctcgtcatccgtggcggccatgcggaaggtgtcccacagtccccggctctcccgggctccgccccacatggcaaacaccagggcgaggcaccccaccggggcatagcaggggacggcgctccgctccggcagcaccagccgggccacacagtccgccgccatcaccacggcggagaccaccgccagcagctcgctggtgcatcgcttctgcagcagcgagccgaacgccttggcgaatacctgccgggccaggacggccaccgccgcaaggcacgccagcagcacaccgctctggacggctgcgtcgccggtccagtagcggatctcatagccgtaggcctcgatccccatagggatcaccggcagcagcgagatcagtaccgctgccaggatagggtgcttgcgccgcttggcctccgcccggtagtccgccgccgcctcagccagctccggctccggaccgatggtgtcgatctccgggatctcctccggcgcctcctccggttccggcggggcgtagagctcctccgtctccatcaggcgcttccgggagaacaggccccgccggggccgcagcaggggctcctgagcctcctcttccatcaccgcgtccacggtgctgcccaccacatcctccagcgtgatggggtggggagagggcggcagatcctgccgcagctcctccagcaggtcctccggctgggcgggcggcttttggggcggagctgttttttccgtcacctggggggcgggacgcggccgcgcctccgtttgcagaggcggcttcttcgcgccgccctccgccggaggggcggccggctccgtctcccggcgggcctcctgctccacggcctccataagccgctgctcccggcctgcgccgtattccgccaggatctcctccagggagaagtcctcctccaacgccgggacatccgtgcccccggtcagaccgctatcaaactctctctcgtctttggaagccatgctgcccctttcctctccgctgtgtccccggcccttcaggccatccgctggcgcaccgcctcatacagcaggatcgccgcggcggcagaggcattcagggaattcagcttcccccgcatggggatactcaccaaaaagtcgcagttctcggcggccagacgggtcatgccgtccccctcgctgccgatgacgatggcggcgggtcccttcagatccgcgtcgtacagggccgtggtgccgtccgccgccgtgccgaagacccacaccccctgttttttcagatccttcagcagagcggggatgttgggcacccgggccaccggcacgtgggccaccgctccggcggaggtcttggccaccacggcggtgaggcccgcgctgcggcgcttggggatcaccacgccgtgagccccggcgcactcagcggtccggatgatggcccccaggttgtgggggtcggagatctcgtcgcacaccaccagcaggggggctcgcccttgtcccgggcggcctgaaggatgctctccacactgacgtactcccggaccgctgccagggcgatgacgccctggtgggcatgggtgcggctcatggcgtccagcttccgccggtccgcctccaccaccaccacgcccgccgcccgggctttggaggcaatatgtcccagggtcttgtccgtctctcccttctggaggtaaattttgtcaatcgtctcccctgcccgcagggcctcaatgacggcgttgcgcccctcgatgatgccgtcggcctcggcagtcaggtcctgctttctccgttcttccataacttctccctcaatctgagtattttcgcattcaagaggtagtatagcataggggcgggagtctggaaagtggaattcacagaaaatttatagaaaaccggttccttgtccttgtaggcctgcggcttctgtgatatactttataaatcattttaaggcttcggcactgtctgaaaacagggctggacgcccccgggcagcggaccgcacccccgtctccggcacaggcgggaccggggcggtcccgtttatcctccgggtattgacaggttttcccctgaaaggagttccatacatgaacccaaacgacaataagaacaacaaaaacaacaagcccggcggcaactggcggggcgtggcctctctggtgggctgggcccttctgctgacgatcatcttcagctatgccagcagcgtcatcggcagcactggccgccaggcctcctccatcaacgtggaatacggagagttccaggagatggtggagagcggccaggtggcccgggtggaattcgacaacgcggaggatatcctcctgataacccctgaggaggggtattcctacaccgctgaggacggcaccgtctacaccaagacggaggacggctacacttatatggacgccgccgggcaggagcagactgcccacctggagctgttcactgtccggatccagtccaatgacgccgtcattgatttcctgaacgagtatggggtggagggcgtcgacaaggagtatcaggccccggtgaacccggtgctggccatgctggtgagctacgtgttgccctttgtgctgatcttcctgatgttctccctggtcatgcgttggatggcgaaaaagggcggcatgggaggaatgggcggcatcggcggcgtgggcaaggccaacgccaaggtgtatatggagaagtccaccggcgtcaccttcaaggatgtggccggccaggacgaggccaaggagtccctgacagagatcatcgacttcctgcacaacccccagaagtacacggagatcggcgcgaagctccccaagggcgcgctgctggtcggccctccgggcaccggcaagacgctgctggccaaggctgtggccggcgaagccaacgtcccgtttttctccatctccggctccgacttcgtggagatgttcgtgggcgtgggcgccagccgcgtccgggacctctttaaggaggcggccaaggtggccccctgcatcgtgttcatcgacgagatcgacaccatcggcaaatcccgggacaaccgcatgggcggcaacgacgagcgggagcagacattgaaccagctgctggcggagatggacggctttgaccccaccaagggcatcattctgctggccgccaccaaccggcctgaggtgctggaccaggcgctgctgcggcccggccggtttgaccggcgcatcaccatcgaccggcccaacctggcgggacgcattgccacgctgcaggtccacacccgcaacatcaagctggcggaggacgtgaatctgaaaaaggtggccctggccactgcgggctgcgtgggcgcggaccttgccaatctggtgaacgaagcggccctgcgggccgtgcggaagggccgcaagctggtgacccaggaggatcttctggccgccttcgagctggtcattgccggcacggagaagaagggcagcgtcctcaccgagtttgagaaaaagctggtggcctaccacgaggtcggtcacgccatggtggcctacaagcagaaaaacaccgagccggtgcagaagatcaccatcgtcccccacacccagggctctctgggctacaccctgctgatgccagaggaggacaagaccgaactgcgcacccgcgacgagctgatggccaagatcatggtctccatgggcggccgggcggccgaggaagtggtgatgaacaccatgaccaacggcgccagccaggatattcaggacgccaccaacgtggcccggaacatggtggccatgttcggcatgagcgacgagttcggcatgatggcgctggcctcccgccggaaccaatacctggacggcggctacggcatggactgcgcccaggataccgccgcccggatggaccaggcggtgaaggacatcctggaccagtgctaccagcaggccgtggaggtcatcaaggccagccgggaggacatggacaaggtcgtggcctacctgctggagaaggagaccatcaccggcgcagagatggtggctatcatcgagggccgggacccggagctggtggagaacccctacgcctccacccgcgcagaggacaaggcgttccgcccctcctctcccgagaccattgaggcccctgccaagaaggtgcacatgatctcccagaagatcgaatcccccgaggagcccgcccaggagggacagccggagaacccggtgtccgatccctccccttccggcggagacgcccccaggagagcggttccactccgtctgagccgcccaaggacaccccgtgatccccgatcatccccgcgaggcgcgctgaccccagcgcgcctcgcttttcccatcgccactacatcaaaaaggagaatcgccatgatccgactcgccaccccgcggacctgtctcaggccgcagatatctatgaggagatcctggaccgagaggcacagggccccgtctataccaactggcagcggggcaaataccccaccatcgacaccgcccgccaggccctggaggccggcaccttctacgtgggcgaggagaacggcgtcctctggggcgtggtgaacctgaacagcgtccagctgccggagtacggcgccatcccttggaccatccccgccgctgcggaggaggtaggggtgatccataccctgtgcatccgtccctcctgctccggccggggatatgcccgacagatggtggccttctgtgaggcggaggctcgccgccagggccgtaccgtcatccggctggacacctgggaggggaacctgcccgccaaccgcctgtacccctccctgggctaccgctacgccggaacggcggagttcttcttcatgggctttgtgcgggagaatctcaactgctacgaaaaggccctctgaatccattgagacgcaagggcttttctcctctgctaaccgtgggttgacagatttccactccccagttggtggcctgggggcaggctgtctgctagtctgacggcgaaaggaggcgagggatgtgaccattgggcagcgcatcgcgcagaagcggaaggagctggggctgtcccaggaggctctggggagcaagctgggcgtctcccgccagtccatctacaaatgggaggcagactccgccctgccggaggtcgacaagctgatcgccctcagccgcctgttcggcgtctctgtgggatggctgctgggcgtggaggaaccgccggaggcggatgccgctcctgctgaaacaggcggcgggctgacagaggcccagctgaagatggtggaggagatcgcaggccgctacattgccgcccagccgtcgccccggaagcgccgccgctggccttgggtgttggcggcagcggcgctgtgcctggtgctgttccacctcttcgaccgtctggaccgaatgaacggccagtatgtaaatctgcagaacagcctctaccgggtggagtccagtgtgtacggccagatcggctccctctccaaccgggtggaggagatcttgaaggcccagaacagcctggtggcggactgcggtgtggagctggaagccgtggaccttgccgccaacaccgtcaccttctccgcctatgctgtccccaagacctatgtggagggaatggctgtggagttcctggcggaaaacggcgagactgccagcgaccggctgggcagtgtgggagaagagggccccaaccaacggttctccgccacactctccatccccttgacggaccatatcaccctctcggcgctgctggtcccgccggacggcacccgccagacccagctgttggaccagtttgaggggctgtacagcgcctctctgccgcaagtggaggtcaacagcgatctcatgtggatggatctggaggacagcacgctggtcctgaatgcgtccagccacgagcgctatgtttatatccgtgaggtgacaccggctgatgcgtctctcaccgcggccgtggcaaatatccgggtgggcctgttcaaaaatcagaaactggcagcctgggcagagccctgtgaaaagcctgacagcttccacggctttgaagaatttgatttttaccagctgccggagctgcgcctctccctcacgcctgcggatacggtacaggtggctgccgtggtgacggatatctatggacgggtcacggtctcccaggatgtgccctacattctcgatgagagcggagatgcgctgacttggccagacagcagtgagacagatcccgatcccgcccactggcagtacggcggatgaccgccgcgcaaattgtttccggattttgaacattttgtgaatgaaatcatccgtttttgaccagtctgtaaacaaagtatgaagctttcccccaggctgttgactttcccggctgggggcagtatgatgagcacaacaagcaggaagcttgtgacacacatcattttccctctcctttctctatatcatacagacgccggggcggtccgaaaggaccgccccggcgccgtttttctgctgtccctgcccgattattgctttttcatttttatcgaaaaacaataaaaaataattgacaaacaataactacacgtggtacgatacggaaaaaggggggaattcctatgccgtccagccgtctctggcgtgttctgctggcgctgctgcttctggcggccctgttctgcgttcccagtctggtgctgacaggcagcgaatggctgccggagctgacaggcgcggtggagaactatgtgcccttctggaaggggctgcttcggttcctgattttctgtgcctggtgctgggtgtggctctggacagagggttccgcgctccagatcctgctggcgcttctcctgcagttctgcggcatctgggccttgtgcctgctgcgtccccgtccggccagccgggcccattctcacgcataaggaggaaagcgaccatgtccaacagtactgtgcaaatactcgcccgggtgctccgggtactgctgatcttcgccctactgctcaacgtcctggctctgctgctggttcccgcctccgtcatggtcaacgcggaaaacctcttcggcggcgccggcacctttctgcatgacctgttccacccggaggcggacgatgtgaccgccgcaggcgtatccgcgatttttctctcctgggtctggatatggggcgagggcgccaacgccctaatcgccctgttcttggtgatctgcggcatctgcaccgcgctgattctcctccaggggctccgggtgctgggcaccatcctccagggtgcgccgttttccacgcagaatgccgtcagcctccgacgggcggctgtatgttccttctgcatcgcgggagcggcattgctccggacgatctgggggctgtggttttaccagtccctccgccccctggccacctacaacgcgctctttgtgccgatcttcaccatgttcggcctgctgtgcctggtgatgtccgccctgttccgccaggcgacggagatgaaagtggaaaacgacctgaccatttaggaggaggcccacgccatggttcgtactgctgtccaaaaaatcgcggatgtgttgatttttctctgcggtttcctcatcttttgcgacattctgctgcttcccctgacaccggccctggcctacttccgctttcagaatccggcgtccatgcgcttcgaccacctcctggctgttttcgcctacgactttgacgacggggtgggaaatttgctggaaattattttgaaagagtcttggaagtccccggagaccgcggtcctggctctattcctgcttttggcgggcatctgcggcgcagtgatcctggtccagggcatccgtctgctggcctctgtggcggacggcacgccgttctccccgaagaacgccgtctacctccagcgggccgccgcaggctgctttgtgatcgccgccggcgccctggggcggaccgccttcaccctctgccgggatggcgccgccgcattgctgtcctacaccgctttgttcatccccctcttcaccatggcgggccttctgtgcctggtgatggccgggctgtttcaccgggcagcggagatgaaggcggaaaacgacctgacgatttgaggtgacggcatgattgtagtcaacctggacgtgatgatggccaagcggaaaatgtccctctcccaactgtcggagaaagtggatatcaccctggccaacctgtccattctgaaaaacaacaaggccaaggccgtccgtttctccacgctggaggccatctgcgccgccctggactgccagccgggagacattctggagttcgtgccggacgaagaggcggaaccatgaccgccaggcgcacggctccgccccgccaggagcgggcctgcatctgccgtccccgcattttccctgctggcggcgcagctcttcccgcccacgttcttcagcgccgcctggccgggagtggtattggtcctcctgctggggtggatccctgtgtccttctgcccctggtatctctggggatccgcctctggagccgggcagatcgcggaagatgggacccagtgtactgcgggacatcttctgcggattgtatccggcggcggtcagtctgccgatctgccccggaaggccgccggggccgttgcggtatctcataacgccgtttcggatactccttctgatgctgacgcgataaaggctgcgcttttggaatctttactgttggaggtttctcgcgatgtttcagctttcgctgtttaccgagttcggcaggctgtgcaacccctttgactatgttttggggtttacgttcctgctgatggcctttcacctgctcttcctgctcttcaatctgcgggagcggcagcgggtgaagctcttctgcctgggcagcgcctcgctggtcctgctgctgcatattgcggcgctgcggctctcgttccagttcaccaatctcacctttgacgctgtggagaccggcccggcgccgggcctgctggcgacgctgggcagccgtacctggctgtatccactcttcctctacctgcttctgctgcccctggtgtgtgtcccgcccaggcaagacagttccccggacaactccggtttccgcaaggaggtggacgcatgattgatgccccattctgcaatgcggtcagcctgctgacgggctttaccggctgggtgctggcggtgtggtcctttctccgtcctgagagggaccgctccggctggaagctggccggcggcgggatggcctgcgccctggccctgctggcccagctcttcgccgtgcagctggagaccgtggcgggtgatttggaaacggccctggtccaggcctccggcgcagctatcgccggccggatcctgtttgtgataacgctgatctttgaaaccatggccgtggtgagccaccactttgccgccagagaccgaacgtaacgtgcattgactgtccctgctgtggagacagccccaaaaaaggagaacccattatgaatgaacatgaaaaagccctgccggcgggagggccggcgaagcttacgcaaaatgcggtgaaaatttatgtgatctcctcccgagagcgactgcttctgccgctggccttctgcttctgtcttctgctggtgaacacgctgctttggagcggccccaccgcgggactgaccgcctccgtctgcgtctggtacggcctgctggggctctatctgggccgccccctgctgaacacctgggagagccgcgttctgctggcggtgaatctggccctggccgccacgctggccctggggtccaactggtatttccgggcgtggaatctgctggccctgctggccctgctgcccgtccacgccatcggcctctccggcggacaatttctgccctggtggcgtccctccatgctgtgggagcggctctgtttgctgctgtggggcctcttcggccatctgggggcagcattggccaccgcctggcctcagaaaaaggacggcgccgcccggcgggtcctgcccctgctgctgggagcggccggcgccctggctctgctggcggtcctggtgcccgttctggcctccgccgacgcgctgttcgccgccgccacggcggacctgcgggcctttgtctccctccacttcacggacgcggtctggaaggccctgctggccagcgtcatgacccccttcctcttcggtctgctgtacagtctccgccgccccacacccctgaaacggaccggagccgcagcccgcggcggggtagacggcctgggcttcgccatcgtgctggcggcggtggcggcgctgtacctgctgttcctgggcgtccaatccgccggactcttcggcggagctgagtacctggcccaaaagggcctttcctatgccgagtgggcccggagcggtttcttccagatggtgggggtgacagtggtgaacctgacgcttctgctggctgcggtccagtggtcccgccgggagggcggcgcttggcgggcagtccggctcctctccgccctgctgacagcggagagcctgctcctgctcctctctgccgcctggcggatgacgctgtatgtggatgtgtacggcctgtccttcaagcgctgcatgacctactggggcatggggatgatggcggcctttctgctggctgcggcctggaaggtgtggcggccagacttccggttctgtcgggtggtgtttcccctggccctggcggggtggctggtcatcaactgcgtgccggtggactacctggtggcaaaggatcaggtggaccgctacctctccggggagagcggggtgctggacgcggagtacctgctctatgacctctcctatgacaccctgtcccagctggagcggctggacggagacatggtctgcacagcgtatggggactgggacgccatcggtacggcccgcctgtccatcttattgaaacagcggcggcaggaggcccggacagactgcgccgactggcggacctggagcctctcggcctggctggccagccggggcgacgcgtaaggggtccgggcatgaagcgctatctgcggctggccgcctggtgcctggggcttgcgctggccgtaacagcctgcggcagggcgggccggatcgtcctcccggaggcggcggaggtcactgccatccgggtaacggcaggagatgcggtgacgctccacacggaccgggactggatcggagaatttctccaacaggcggcagaggctgtctccaccggcatggagagcgtgcaggacgcgccggaccaaaccggtgcggtaaaggtggagctgggcaccggcgagacgccggactggagcgttctgtacgtctacgaagcggacggcatctgctgtttggagcagccctatacgggcatctaccagggggacgaggcactctggacagttctggcggctgacgccgcgccggaggggaggaatccacagtgaacaggccgtcggccggttggatcgtgtgcctgctgctctgcggcatgttgatcgccggggtgttctatctgatcggctacaaggccgcctatgaccggatggaaaacaccgtgccgtccacggtggaggtctcagttgcatggcagaaggtgagtccatgtggaagctgatgggcgggctgctggcactgccggtcctgctggttctgtcggtcctgatgatcttctggggcagcggcgattatgtcagaaccgttcagctcaactgggagctggagctccccgccagcgagggctgtctgtatgagaccgacagcggcgccagctttagcggggacggggagcggtatcacgtcctggcatacgcggacgacagcgggctggaggaaaccctgacagaggaagctacgccggtcaggtccgcagaagtgccagtgaccgaaatcctggatctgctggccgttccggcggaccagcggcccgatttttcggactgccgcggcttcacggcggcgcacccaacggatgaacgcaaccggctgtacctgctggtaaacagcgcaggtacccggctgtatgtggtggagtgctttttttgagcagaaaaacagcggcggccatgggtttccatggccgccgcttggcggtttcgcttattcctcatctcggccgtggccgcaccagggacagaccggctgtgctgccggaaaccattttccgcaccaggggcagggctgatcccgccgggtcccgcacagggggcaaaaggcatcgtcacggggatgctccttgccgcagaccgggcatttgaccagctcccccgtaccgggaacgtagaaggcggcggtgtccacgtctgttggttccggctccaccggcacatgttttttcggctgagggagaaagttggtgcggaaaaaggccagtcttccacaggcggggcagctgtatatatccacctcaatccagtcggtgacggaggcaaaaaggcccgtcagagccaggcgcctgcccgcctgccagaggtccatctgccccccccgcactgggggcaacccaccggcgtgttcggattcatctcccgcacctccgcatgctcacatccgcaggctctccggataatctcccctggcatggagcttgcggagctcctccgccacgatctcccggtcctcatggtaggtcatgccgaaccacttgtccgcggagtgaaggacggacacctccagcgcgcccttttgcagctgatcccccaccatcaccggcagcaggcactcggccttgatattttccccggcctccgtgcggaggaagttttcaaagtactcccgcagggcggggaagatgctgggggcaaacccccagaagttcatggacaccaccgtctccggggacaggtccgtgccctccgccagatcccgcagcgtgccgtcgggatacagctggatcttcagtgcctcccggacggagcggagctttccgtcctccaccgcgcacacgccgcgggacaccgtgccgtggaggctggcggtattcttcagcagataccccaccatggtggcctttcccgtctcaggcagcttcaccagctcgtcatagatggtgcggtaggcgtcaatgccgtaatagtcgtcggcattgatgacgcagaagggctcgtgcaccacatccgccgcgcacagcagggcatggaccgtgccgaagggcttggtccgctccggcggaatccggtagaagtccggcacggaggtaaagtcctgaaagacataggccacctccaccggcgtgccgtccagtgcggtcttcctcgccagataatccccgcacaggcggcgcatcatctcctccatctccggcttgatgatgaacaccaccttgctgaaccccgcccggagggcgtcgtagatggagtactccatcaggatctcgttgtggggcccgatgccgtccacctgcttgctgccgccgtagcgggacccaaggcccgccgccatgatgaccagtgagactttcatttgcttctctcctaaagtttttgtgaatttgcgccttgttgcgcaaccatacgctgttcttttaccataccctatttgccggatttttgcaactgctcttgacttttttcctctgcggtctataatatgaaaacgataatcattttcagattaaaggaggcattggatgccatacagcaccaaacagcaccaggcggtgctccgctgcctggaggcccggggcgagaccgcctgcaccgccgccgaactggcggaggacctgcgtcgggagggctgcccggtgggcctggccaccatctaccgccagctggaaaagctggaggccgccggggcggtccacaaggtcaacaccgaggagggcgccctgtaccagtactgcggccgccagtcccaaggccaccgggattgctttcttctgaagtgtgagcgctgcggccgcatccgccatgtggactgtacccgcctgcagaacctgtacgaccacctggagcgggagcaccacttccgcatcgatccccgggggacgctgttttccggggtgtgcgacgtctgcgccggagaggaggaccaccatggagcccaatgagctgatcgtctgccgggacgcgtccctggggtatgagggtcagagcgtcctggcccacctggatctcaccatccgggcgggggactacctgtgcatcgtgggggacaacggctccggcaagtccacgttgctgcggggcctgctggggctcctctccccccagtccggggagattctccgggcgccggaactgcggcagggagccgtgggctatctgccccagcagacccgggcccagcgggacttcccggccacggtgtatgaagtggtcctctcgggctgcctgaaccagaaggggctgcggttcttctacaccgccgcccagaagtccgcggcattgatgaacatgggcaagctggggattctggagctgaaggaccagagctaccgggatctctccggcggccagcagcagcgggtgctgctggcccgggccctgtgtgccgcccgcagcctgctgatcctggacgagcccattaccggcctggaccccgccgcggcccaggatctgtacaagaccctctcctacctgaaccggaaggagggcatggcggtggtgatggtgacccacgatctgagggccgccctgcgcagcgcccggacggtgctgcacatcggccacagcagctactttttaggcacagtcaaagactatctggcctccccccaggggcggcggtttcgggaggtggaggaatgagcctgaccttgatgctgacctatccctttatgcagcgggccctgatcgccgggacgctggtaagcctctgcgccgcgctgctgggagtccccctggtactgaagcggtactccatgatcggcgatggcctcagccacgtctccttcggcgccctggccatcgccgtggccctggggttcactcccctctacttctccatccccgtggtgatcctcgcggcgttcttcctgctgcggctggccaccaatccccgctggaacagcgacgcggccatcgccgtcatgagtgcgtcggccctggccgtcggcatcatcgtcatctcccgcaccagcggcatgaccacggatgtggacaactacatgttcggcagcgtcctggccatgacgtgggcggatgtggccctgtctgcggtactgtcccttgcggtgctggccctgttcgtgctgttctaccacaagctcttcgccgtgacgttcgatgagagcttctcccgggccacggggctgcgggtggactggtacaacaccctgctggccattctcaccgccctgaccatcgtgctggggatgcggatgatgggtgccatgctgatctcctccctggtgatcttcccggcgctgacggccatgcggctgttcaagagcttccggggcgtggtggtatgtgccgccgttacgtcggtgtgctgcttctgcgcgggactcatggcctcctggacgctgtccacgccggtgggagcctctgtggtggcggcaaatctcgcgctgtttctgctctcctgtgctgccggctggctgcgcaggcgctgaaaaccgccggatctgcggctgtgccgtatatccggcggatttttttatacaatattagaaaagaatctggcagaaaaggcttgcgcttttccagtatctgtgctatgatgcgtatgttagaagagtaaggtatgtggagtgggctgcggggtccgctctttttcttgacctttttcggtcaggcaaactctgcttaaacttccaaaagaagggagtcctcccatgaaaaagatcactgaactgaccgcggaactggccgctcccgctatcgcggaacagggctgcaccctctgggacgtggagtacgtcaaggaggccggcacctggtatctgcgcattctgctggacaaagagggcggcgtggacattctggattgtgaggagatctcccggaaggtcagcgacctgctggacaaggccgaccccatcgagggcagctacaccctggaggtgggctccgccggtgccgagcgggcgctgaagcggccctccgattttcagcagtttctgggcagccccgtgctggtgaagctgtaccgggcccgggagggccggaaggagtttgccggctatctgaagggctatgacgaggccaccggcgatgtcaccgtcaccgtgggcagccaggatctggtcttccccaagaaggagactgcccttatccgcctgcgggtggaattttaaccaatcaccgtcccgacaagacgtattttatcaacaaggagaatcagcaacatgaaaggcaaaaagcagaaggagcccgtaggcttcaatcccgcggaaatcttcgcggcactggctctgctggagaaggagcggggcatcccccagtccttcatgatggagaagattgtccaggccctcaccaccgcctacaagcgggaccacgcggatgtggagaacgtcatcgtggatgtggacgaggcacaccagaacctgaagatgttcgtccagaaaaacgtggtggaggaagaggactacgtggaccccgccaacgagatgcccattgaggaggccaagaggctctccgccaagtacgaggtgggcgacatcgtgaacatccctgtggacacggtggagttcggccgcatcgcagcaggcaacggcaagcaggtcatcatccagggcctgcgggaggccgagcggggccaggtgtatgatgagttcaactccaagcagcatgagatcctcaccggcgtagtcacccgtgtggatccccgcaacggcaatgtgtccctgcggatcggcaccggcaccgactctaccgaggcgctgctgatggccggtgagcaggtccccggcgaggatctgaccgaaggcatgcatgtgaaggtctatgtggtggaggttcgccggtccacccgcgggccccaggtgctgatctcccggacccatccgggcctggtgaagcgcctgttcgaactggaggtccccgagatttatgacggcaccgtggaggtgaaatccatcgcccgtgaagccggcagccgcaccaagatggccgtgtggtccaacgacgagaacgtggaccccatcggcgcctgcgtgggccccaagggccagcgtgtgggcagcattgtggaggagctgcggggcgagaagatcgacatcgtcaagtacagcgaagacccggcccagtttatcgccgccgccctggcgcctgccgacgtggtggatgtgtggatggcggacgagggcaaggcctgccgcgtcatcgtgccggatgaccagttgtccctggccattggcaaggagggacagaacgcccgcctggcggcccgcctcaccggctacaaaatcgacatcaagccggagagctatcacgacgaggaagagccccctgccgggggcgccccggaggccgcggacacggcggaagcgtccgctgtggagcccgtggacgcggagtaagatcagtttatcagaaaggcggcctatgagatgccgaaagtgaagaagattccccagcggcagtgcgtgggctgccgggaaatgaaggataagaaggccttgctgcgggtggtcaaggccccggacggcaccgtgtccctggacttcggcggcaagaagcccgggcggggcgcctatgtgtgccacgacgtggcctgcctgcagaaggcccggaaaacccgggccctggaacgggcctttgacaccgccatcccgccggaggtctacgacgccatggaggcagaactgcgaggtgcggatggaccggcttaacattctgtccctgctgggtctcagcctgcggggcggccggttggccgtgggcgaggagccggtagaggccgtggcccgcgcccgggacgcccgggtgctgctgctggccgccgacgcggcggagggcacccgccgccggtgcgagcacttcgcccaggccggtgactgcctgtggctccagctccccttcaccaaggcggaactgggccgggccctgggccggacggccgtggccatcgccgcggtgacggacgtgggactggccgccgccctgctgcaccggctggcggagctggatccggagcagtacgccgacgcggcggaccggatggatgtaaaggcccgccgggccgcggagcgccgggcggagcaggcggcccatgagaagaatctccgccagggcaagcgccgccgaaaggcgccgcctgcaccaaaggcggccaaacctccggcggaaatgccaccggagcgtgcgccagacgggaaccgtccccgcggcgcaaagccataccgatcccgtcccccagggacgctcgccccaagccgaaggcacaggcgcggccatacgccaacagccgcccggtgaaaaagggcaaaggctccttccgcaagaaaaaggaaggctgacggaccgcgccgccgcggcatgtgtccgcggcagctatttgaaaaaatttcccagccctcgggttggagcagaacgaggtgtttctattgggtattgagaaatacagagtccatgaggtggcgaaggatttcggccttcccaccaagaccatcacggagatcctgacgaaatacgccgagactcccaaaaaccacatgcaggcgctgacagatcaggagctctctctgatctttgaatacctgacgcagcacaatccggtctccagcatccaggtgatcttcgccgacacctacaaggaggagcctgcgaaggaaccagccaccaaaaagccagagcccgccggcaaggccgccgcgcccgcccagggccagcaggtcaggcagtctgtgcctgcccagagcgcgcagagcagccagggtggccggcagcagccccagcagcagaacgccgcctccaagcctgcggcgcagcagccggtgtcccgggtgccccagcggaagatcgtggacacccgcaagggcggcgacgtgaatctggccaagtatgatgagcggctggaggatctgggcggcgagcggggcgctcggatgcagcggcagcagcgcagcggcaaggagaagatccgcaccaacaaccagcgccggggcggcatgaccttctccaacaagcgcaagcaggacgaggcagagcggatgcgcaggctccagctggagatcgccaagaaggcccctgtgaaggtcatgatccccgatgagatctccgtgggcgaactggccagccgcatgaagaaaaccggcgcagaggtggtcaagtgcctgatgaagaacggcattatggcctccctcagccagatcattgacttcgacaccgccgccatcatcgccgaggagatgggctgcaaggtggagaaggaggttgtcgtcaccatcgaggagcggctgattgacgaccacgaggacaaggcggaggatctggtgccccgggctcccgtggtggtggtcatgggtcacgtggaccacggcaagacctccctgctggataccatccgccacacctctgtggcggccggagaggccggcggcatcacccagcacatcggcgcctatcaggtgcaggtgaacggcaagcccatcaccttcctggacacgccgggccatgaggcattcacctccatgcgggcccgcggcgccatgattacggacattgccattctggtggtggcagcggacgacggcatcatgccccagaccgtggagtccatcaaccatgccaaggccgcaggtatccccatcatcgtggccatcaacaagatcgacagggagaacgccaacccggaccgggtgcttcagcagctgacggagtacggcctggtaccagaggactggggcggcgacaccatctgctgtaggatctccgccaagcagaagatcggcatcgaaaacctgctggaaatggtgaccctcaccgctgagatggcggagctgaaggccaaccccaaccggtctgccaagggcaccgtcatcgaggcccggctggacaagggccggggccccgtggccactctgctggtgcagaacggcacactgaagcagggcgacatcatcatcgccggcaccgccgtgggccgtgtccggaccatgatggactacaagggcgcccgtctcacccaggccggcccctccgtacccgtagagatcgcgggcctctccgaagcgccctctgccggcagccccttcttcgccgtggccgacgagcgcatggcccgggagctggtggagcagcgcaaggccgaggagaaggccaaggccgccgcaccggtgcagaaggtctctctggagaacctgtttgaccagatccaggccggcgaacgcaaggagctggccctgatcgtcaaggccgacgtccagggcagtgtggaggcggtgaaggcctctctggaaaagctgtccaacgacgaagtgaccgtccgtgtcattcacggtggcgtgggcgccatcaacgagtccgacgtgatgctggctgcctcctccggcgccatcatcgtgggcttcaacgtccggccggacgccgccgcccgggacggcgcggtgcgccagaacgtggatatgcggatgtatcgcgtcatctatgactgcatcgatgagatcgaggcggccatgaagggcatgctggcccccaagtaccgggaagtggtgctgggccacgcggaggtccgccagacctacaaggtctccagcgtgggcaccgtggccggctgctacgtccaggacggcaagatcgtccgtagctgctccgtccgggtggtccgggacggcatcgtgatccacgagggctctctggcctccctgaagcggttcaaggacgacgcccgggaggtcgctgagaactacgagtgcggcctgaccgtggagaagttcaacgacatcaaagagggcgatatcatcgaggcgtttaccatggaggagattccgcggtaatgtgctgggcctgacgctgtataccgcctctccgccgccctttcgggtcgcagagcggccccgcacggcagtgcgcccaagcgtgccgcggttggctctgcccgccgaggatgtctgattcagagttcctgtgaaacccatttcatggggcgtgcggtatcatcgaggtgtttaccatgaacagcttccccggtaatgggcctgcctcatcagatcgcaatcatcaaccatacttgcaatagccggcagggcgggcgtaaacgcccgccctgctttttcagaaggagcgcctatgagccgcgtgatcctgctttgcgccgatcatccccttccgctgtatgccgcccagacccgccgggtctatttccaccgcggcgtgcggtatgaggaggaaggattttctgttcagccccatgtctactaccgccctgcggtggacaacctggagctgtccatgaaaccccatcgctatgagctggacctgcgtgctacggagcaggacgccgccctgctgcgggactatctgcggcagagctgcattcccggtgaacaggtggagctgtggaacctgtgggtgagcgatatccgggtccgggcctttcgcctgacgggcccgctggcagatctggacgccgacgccctggtgcagatggaggagcgggagcagacctgcattaccctgaccatataagcgctccaaccaagcgcaattccaatgaactcccataaggaggtatctctctatgccaagcaatcgaatcggccggatcaacgaggagatccagcgggagctggcggaccagctccgccgtctgaaggacccccgtgtctcccaggtgggtatggtatccatcacccgggtggacaccaccagcgacctgcgatacgcccgggtctatatcagtgttctggacaaggaccaggagaaagacgtgctgaagggcctgaaatccgccggcggcttcctgcggcgggagctgggacgggccctgcagctgcgatacacgccggagctgcagttcatcgccgacgactccatccagcacggcgcccacatcctggagatcctgcgccaggtggagcggcaggatgaagcccgggacgacccggacgccggcgaaacggaggaatgagcatgctgacggtcccccagaccgcggcgctgctgcggacctttgacaatattctgatcctcacccatgtccgcccggatggggacacggtgggctgtgccgcagccctgtgcgcaggactgcggtctctgggcaaggcggcgtttctgctgcccaatccggagctgacagacaccaccgccccctatttccgcccttacgaggcgccggaaggcttcacaccggacaaggtggtgtccacggacatcgccacggtgggcctgttcccggagaacgccagaccatacgcggaacgggtggatctggccattgaccaccatccctcttttgagtcctttggccgagagaatatcgtccggccggaagccgccgcgtgcggagagctaatctacgacattctgtccgatctgggccccatcacgccggagatggcccttccgctgtatgtggccgtctccacggacacaggctgctttgcctacgccaataccactgcccagacccatgcggtggcggccgcgctgctgcggaccggcatcgactatcagaccgtcaacaaggtgttcttccgcaccaagagccgcaggcggatgcagctggaggccgccatcctcaacgactgtacgttttacgaccgagaccgggtggcggtgctgtccgtgcccctctccctgatggcgcggatcggcgcctcggaaacggatgcggaggacctctccgctctgggtccccagattgagggcgtggactgcgccatcaccatgcgggagctgcggcccgatgtgtggaagatgtccctgcggaccggtccccggattaatgccacggaggcctgccggctgctgggcggcggcggccacgcggccgccgcaggctgcacggtggaggccccctgggctgaggccagggagcgaatcctggctgccgtggcgcaggtggcgccggactatcagcgctgagcgggccgcgttctgctgcccttgaggaggtttttatgcccagtggtatcctgattatcgacaagcccgccggttggaccagcatggacgtctgcgccaaggtgcggggcatcttccacgaaaagcgggtgggacacggcggaacgctggaccccatggccaccggggtgctgccggtctttgtggggcaggccacccgcggggtggagttcgcagagaacggccagaaggaatatgtagccggtctgcggctcggccaggtgacggacacccaggacgtcaccggcaccacgctggagacccgtcccgtcacggcggatcgggcagcactggaagcgctgctgccccgctttctgggagagcaggaccagatcccccctatgtactccgctgtcaaggtaggcgggcagaaactctacgacctggcccggaagggacaggtcgtggaacggaagccccgccgcatcaccatctacgagctggagctactggcccaggagagcgcaacggactacctgctccgctgccgctgctccaagggcacctacatccgcaccctctgccatgacatcggccgacagctgggctgcggcgggacgctgtacgccctccgccgcaccatggcggccggcttcaggttggaccaggcagtgacgctggaggcagtccaggcacagggtacagcgctcctgctgcctacggacagcctcttcgcagagtacccggccctgcctctgacatccggcctgctggagaaacgggtccgctgcggcaatcccatccccctgccgggcacaccggacggcatctaccgcgtatacagccgggaccggcagttcctgtgcctgtcccgggctgcgggcggaacgctgacgtccatcaagaatttctttggagcgtaaaccatgaaagaacgagtcattgccctgggcttttttgacggagtccacctggggcacggcgccctgctgcgccgggccgctgaggaggccgccctgcggggctgtacccccgcggtattcacctttgaccgcccgccgaaggaggtggtcaccggcgtcccctgtcccctcatcaactccccggaggaccggcgggacctggtgcggcggctgtaccgcattcaggacgtgctgatggtcccctttgaccgcgagatgatgaccacgccctgggatgactttattgtccggatcctggtgggccgctaccacgcggtccatctggtggcgggacacgatcaccacttcggccacaggaaccagggcacaccggagctgctggcgcagaagtgcgcccagctgggcctgggctgtgacatcatccccaaggtggaggtagcaggcatcaccgtcagctccacctacatccgccggttggtggagctggggcagatcagccgggccaaccgcttcctgggccacccccacaccctgacaggcacagtccgccacggccggggcatcggctcctcccaactgttccccactgccaacctcgtcattccgcctcatgtgctggtgccgagccacggagtatacgccacccgggccacactggaggacggctcctgctacgccgctgtcaccaacgtgggcacccgccccacggttcaaaacggctcggacatcacagtggaggcctgtctcctggacttccagggggacctgtacggtaaacagctgcggctggagttttatgagcatctgcgccaggaggtgcgcttcgactccctggacgccctgcgggcccagatccagtcggatgcagacgccacccggacctatttcgcagacggggtccccaccttccctgccctttgatcctccatgaaacagcgcggagtccggaatcggactccgcgctgttttcagatcagccacaccgtcagccacaccaagccgatcccggcagcgcccatcagggtgtagaccgccggggaaagatcccgccagatccggctgaaccgcccatggtctccgccggcatagtttcgcgccacccggcgggcctcctccaccagctcccgggcggtgacgccctcgccggccgcatcgttccgcacgatgaagatcgcctgctcaaaaaaacgctggtccggggaatccaccaccacgacccgtctggaaatgcctttcaccatccgctttacgcctcctgcctctcacagaatttagatggttccattttgtctcagcgcgggaaaatttataccgcctctcacacctttttcacaccgctctcccggctgagatacagcacctgaaccccgcagtcgtcctgaagattctcccgccggacgctctcgctgaggatcagtcccgccagggtctgcggatcctctccatcccagccggccagcaggttttgaagccattcgtcccggcccgggtctgccaccccgtcgctgaccattactacaaagcttcccggctccagcgtggcacgggtcacatccggagccgccgccccgccccgcagacccgccggcagggtcccgccggtgatccgccggacagtgccccccttcttcacatagctgggggccgcgccgtatttgaagaaggccgcctcccccgtctccggtctgcaggtgatgagatcaatggtggtgaagcttccggtctccgcgccccgcagggccatggctgcgttcagggtcttcatggccgcctccggctcgatgcccgcctgcaaaaactgctccaacagacggcaggtgagggcggactcccgccgggctgcctctccgctgcccatgccgtccgccagcagcaggcacaggaggcccccctccgtgcggaaggagaccaccgtatccccacagaccgtctccccctccttgggccgcagggccgcgccaatgcggcagagatccgcctcccctgctgtggcacggacctcccccaaaccggcagcggtggcggtcagcagttcactgagctgggcgtactggcccctggcgctgcggcgggtctcctccagctgccgccggtactgccgccgcagcaggaatgcagagagctccccattgacggcggtgagaaagtccggcaggtggatgcaccggtccgcgaagtagctgggaaagtccttggccagcgcgcgcccccgctccagcaggaagggcgtggcgtcgttcagggcgttgaaggtgccggtgtactccttctgccaacagagctcgcacagggcgcagccccggcacaccttttctgccgcccggtcaaagaccaccgccgggttctcctccgtggacaccggggccgccctgcccatgctgtcgtacagggcccgcagagcggcggccatccgggtcagctgggcgcgcatcccctccagcgcggcgggaaactccggtgtctctccccgcatcacccgcttgccgccgaaggctcggcccggcagcatcaaaaacaggaccgctcccaccgcggcctccggcagcaggggcgtggagaggcccgccggcagggcggccagagccgccgctccccagaatgccagcgccgcccagatccgccttccgctactgcggctcccagccagaaggcccgccagaccataggccgccccgaagaggacgccgccccggccggaacagaagtccgccgccaggcccgcccccagtccggcggctaccccggtcatggccccccgctgataggcggtgtaggccagcagcagacacaacagtgaacgccccacggagacaccggccagttctacgtccaccagcgccagcagaatggagcctgccagaaacagcagactatctggctccggccgctcccctccggcctgcagcaggggctgataataccatgcggagatgcctaccagggccgttgccgcaaggcagggcgccaggtttcgcagggggacaaggactggagcacgtagatgccgctcaccgccagaaacagtcccgcccctgccagagggtgaaacagcggtccctccagcagcttcagcccctgaaaggccgccgcggtggtaaagatcaaaatcgcagcggccaaaaagggcagcgcaccggaaaagtccagaaacagcaccgcccccacgccagcgcccagcagggcggcgatccctcctgcccctggcccacaggccgccacgcaccccagggcaaagggcgcgtaatcccccggcgtctgggtggcggtcagcgccgccgccaaaaaaaatcggatgccccaggccagcagctgtgccggctggtgccggctccatatcatgtccctgtgccccacagcttgtccctcctgtattccgccgtgaagtccacggcctctttggttttttccactattttacaggctgtgtggaaaaaatcccgtcgggaaaagaaagccgcgccatttccgggctggatgcccatagtggacttttacggccggatatggtatgataaactatcatgttttcattggaaaggacggcccgccttgaacatcggcacgcttaccatcaactcctccctggccctggcccccatggccggggtcacggacgtcgccttccgccagatctgcgcggaattgggggcgggatataccatcacggagctcatctcctccaaggccctgtgctaccacgacaagaagaccctgtccctgctccagcagtttcccggggagcaccctgcggcagtgcagatcttcggcagtgacccgatctgcatggcagaggcagcccagatcgccctggagcattccggggcggatgtggtggacctgaacatgggctgccccatgggcaagatcgtcaacaacggcgacggggccgccctgatgaaggacccggaaaaggccggacgcatcatggaggcagtggtgaaagccgtctctgtgccggtgaccgccaagttccgccggggctgggacatgggcagctgcaactgcgtggagttcgcccgaatcctggagcaggcaggggcctccgccgtggcggtccacggccggacccgggcccaggtgtacagcggtcaggcggactggacctgcattcgggcggtgaaggaggctgtgtccatcccggtgatcgccaacggcgatatctggaagccggaggacgcggtccgcattctccagcacaccaaagcggacatggccatgatcggtcgcgggtgcttcggcaacccctggctgttccagcaggccaaagccgcgctggagggcaagcccatcccgcccctgccgccgcttgcggagcggtgcgacacagcggtacggcagtttgagctggccgccgcgtccaagggcgagcgggtagccgtgctggaggcccgccgccactactgctggtatctgaagggcgtgtcccactccggctactacaaggaacagatcgtgcagatgaacacgctggaagacgtgtatcgggtgacgaaaggaatcaaaagggatttgagatgaacgagcaatcgcgggaacagcagctggtctccgccgcccgggacggggatatggacgccttcgaggcgctggtccatctgtatgagaaacgggtgttcgccctgacgctgcggatgtgcgggaatcccgaggatgccgccgaggccgcccaagaggcatttctcgccgcctggcaggggctggcattcttccggggagaggccagcttctccacctggctgtaccggctggtgtccaacgcctgcgtggacttgctgcggcgtgatggccgccgccgggcctcggccggcccctccctggatgacgaggagctgaatctggacgtgcccgatccggcgccctctccccaggacgcggcggagcggcaggagctgcgggaagagattgagcggggcctctccgccctctcgccggagcaccgggaggtgctgatcctccgagagattcaccagctgcgctatgatgaaatcgcggactccctctctctggatgtgggcaccgtgaaatcccggatcagccgggcccggaaacagctgcggaattttttgctgaaaagcgggaacttttctccgctgccggcgtctaaaggaacagaaaaggagggctgacaatgacatactgcaaggagttttcggccctgctggacccctatatcgacggagagctttccccggaggaaaccgcccgggtgcgggagcatctgcatacctgtgacggctgccgggcctatgtccaggccgcgctggccatacgggacgcgtttcccgaggcagaggatacccctgtgccggatggcttcgccgcaggcgtgatggctgccatccgggcggacgccgcccccggaagcgccggagaccccggtgggcaaagacgctgctccccttggccgcctgctgtgccgtcgtggtgctggccgtctccggcctgccccgccccggcggcaccgctgtgacggaccatccggaatcccatgcagagattgcggccccagcagaggccgctgtgcccaacgtggacagcgttgaggaggacaccgccgccacggcctatgcaacccagtccgacgaggacacggcagacgtcccggattccactgtgtctgaggcaatcgcgccggaggcggataccgttgcgcccggcacacaggaccagcttgctcccgcctccgattccaaaagcagcattttgccccgggaagggagttctgccgatgtgccggagacggccccggccaccttcgcgatccaatcccccggcctgacgctgacggcggaggaggccggaagcctgctggacagctatacgctcatctctgaatcggacgggactctggtctacgaattgaccgccgccgaatataccgctctgctgcagcagctggaacagcaggggctggccattgcaggcgccgccaccgcagaggaggcggaggccgacggaaccattctggtccacgtgattcccggttaaaaaagcagaagggacgccgaaattttttgcggcgtccctcttcccttttttgaaagcttgtgatataatattatttcgacaggtgccatctccctgtccaagcgtccgacactgggcgttcgttcggcggtcttcgtcaatcgccgttctctaaacaaaaaaatggaggttgcccgtaccttaccacgggcgttttgctgcgttttcgtatcaaaggcctccgacatcattcaaggaggtctttcttttatgtccaaacccagattcaccacacagcagatggccgctgccggtatcatcgccgccatttacgccgccctgacgctgctgctgcccattccccagtatggcggcatccagttccgggtggcggaggccatgacggtcctgcccttcctgttcccggaggccatccccggtcttaccgtcggctgtttcctggccaacctcctgggttctcccattcctctggactggatcgtgggtacggcggccaccctgctggctgcgctctggacatcgaagctccatcacagggcgctggcgcccctgccgccggtgatctgcaatatggtgctggtaggtgcggagatcgcctggttttccacccaggagggtgccgccttctggcccgcgttcgccttcaactccctgaccgtggggatcggcgaggccgccgcttgcttcattctgggctccctgctgctgcgggtcctgcccagagtccccgcactgaagggccggatagcctcttcccgcatctgatgccactctgcgcaaaaaagaagtcccgcgtccgttggacgcgggacttcttttcacttagcggtgaactcgtcctttccggcgccgcacagggggcacacccagtcggcgggcaggtcctcccacttggtgccgggggcgatgccgttgtccggatcgccggcggcctcgtcatacacatagccgcagagatcgcattcgtactgtttcatttgaaagatcctccttctgttataaacgggcgatacacgcctggattccggtggagacagtgcttacttcagcttcttccggatggccgccttgacctccggcgacagcagccggccggcggcccgtactggcagcggcggcaggcggcagaactcccggcgcacctggtcgaagggctccagggcgtaggcggcaaagaatgccgtccgctccggcggcaggggaatgggagatgccagccggggatttccggcaatggcccgttccggcgggaagggctgcttggccagcgggagctggtcaaaaatgtggctgccgtggggggtgttcaccaacagcaggctgatccccttctcctgctggtccggcagctcatccggccgcaggccccagaaatcccccagtgtcagatcgcccacccgggtcatggaggcgtagggacagcggtagcagctgggccgcaggaacagcgcccggccgaaggcccggccgtattccgtgcggaacagcggcgcggtatccacggtgccgtcgccgtagaccgcggtaaaatggctgtccttccatccggcgaccttgttgcggaaacggaccgcctgcagcggctgctgccggcgcgcctccaggctccgggccatgtcctcccacacgccgggagagggcacgccgtggcacaccaggtcgcaggtggtcagattctccggccgtccgcccagatagcggtacagcccgtccacctggcagggtgtgccggaaaacagcactggtcgctggtccaaccagcgccgcacctcccgaaagacgccctccagatcgctctggacgtacttggcgccccgcaggcgccacagctcctccttgcggaagcaggcggtgtgccgcagatgctggctgccgtcaaaggcggcgccaaagaccacgccgccgctttccaggatatactccgccagcagggtgaacacgccgcccgaggtggagtctcttcggatctcatcgtttctattccaggccgcgaatacagcgggcatggagctctgaggccgctcccgcaggacggggcacaccgccgtgcagtgcccgcaccgcacacaggccgctccgtcgatcaccggataggcaaagccctcccggtcccgctccatggtgatggcgtccttgggacagccgctggcgcaggccgtgcagccggtgcagtgggtgtggtccgccaaatggggcaagggccgttcctctgccttgacaggcgcctcctccggtgtatggggccggtcctccagggcgcagcgcagatagtccagggacaacttccgctcccggccgagccgctcccccaccgccgcccagtcgatgggcgccgtcaggtccgcggtatctcccttgccgatgatccgctcccccagtcccaggcggctcaacaggctgaaggtccgggaactctccggcgcagccatctctgccggtgccaccgccgtaaagaagggcttttggaactggacggagaacaccgttccgtggaaggagttggtgcacacataggcggcatcccggaacagacccagaaactccgccggaccggcgctgagaatgcagcgggccttggggtggaccttctggcgtacgccgcacagctgcaccaccggcagccccgtctcctccgccaggcggcggatatagggtgccagggcgtcggggcggctgatgcaatagcagaggatatagccccggcccgcgcctccgtccctggctgcggccgcccaatccgttctctccagcagcagcgtgggatccagcaccaccggcacgtccttcccggtgatgtcccggacaatgccctgcccctgccgctcccggacggacaagtgggagaaggactccagataggtccgcagctcctcctccatgccgtccgggatgcgggggatgccgaaggatggggcataggcgatcttccgcttgtgggagaaggccccgaagaacaccgggtcgaaccggccgtcggggaagatcttcgggttccaaatctggtcactgccggagagcagcacatcgtagggcagctccgcctgccgcagctcctccaggctctggtagcggcggccggaaatgttcagattctcccgggaaaatgcctcaaaccgctcgtatcgggccttcagcgggccatagtgcagggcggtgtgggcgtcatgggcggcgcttcccaggccagtgggccgctggaacagggtattgtcctggttcacgtagtagtcgatgatctcgcattcgctccccagggacgccaccgcccgctccgtggcgtaagcctgcagcatggcgccgtagtgatggatatggtaaaaggtcagcagtcctgttttcaccaagtgtcttcctttccgcagtccggatatcccgccgggcgggtcactgcctgtccagaatggcgtcggcgtcccgggatgccagaaggtcgtcctccgccacccagtccgccacatccaccacgtcgaacgccgtggcggtccggcggatcaccacctctttcagcccggcgttgatgaccagcctccggcacatggagcaggaggtggcatctcccagcagttccccggtccgggcgtcccggcccactaggtacagcgtgccgcccaccatgtcccgccgggaggcggagatgatggcgttcgcctctgcatggacgctgcggcacagctcataccgctctccccggggaacctgcatggcctctcgggagcagtagcccagatccacgcagttggcccgccccggggcgcaccgttgtagccggtggagatgatctcgtcgtttttcacgatgatggccccatagacccggcgcaggcaggtggcccgctccagaacggtctgggcgatatccaggtagtagttggctttgctgatccggtccatgggcgacacctctttctatcgagttcctctattgtatcatgatgccgccgcagtttgcaagaactctccccactctggaagggatttctgttggaagtcaccccagggggcgccggagcccgttctccagccccgcccgcacggcgatcatctctgcggccacggacacggcaatctcctccggcgtctgggcgccgatggccaaaccgatgggagcgtgaaggcgggcgtactcctcgtctgtgaaccccgccgccagcagccgctcccggcacagggccagcttcctcttggagccaatgcagcccaggtatttggcgccgctgcgcagcacctgagtcagcacctcgtagtccgcctgatggccccgggtcatcaccaccacatagtcctccggcgtcaccgtcacctgttcggacagccgggcgaagtccccgcagagggtcttctctgctttggggaacagcgccgggtccgcgaactccggccggtcgtcgtacaccacggggcggaagcccagggaagccagcaccggcaccagggcctgagacacatgtccgccgccgaagagataggtccgcccggccttcaccaccgggatggacagccacttccgggcaaagaccgcctgattcccgcacaggagctccagctcctccggcaggatatccagatgacggggcccggtccggtctgccaggcccatggccgtcacctgctccccctcgatccgccgcaggagccaggtgtcccggtttccgccgtccgcctcgatcagatcccgcaaaacggcgatgatcctctgttctcccgcggggaggtactggaactgcaccgtcactcccccgccgcagaccatgcccaggctggcggcgtctcccagggtaaagcggaactgccgcagggcgtcgcccccccgctccagcagctccgccgccaggcgctggcactcgaactccacgtttccgccgccgatggttccggtgatcccgccgccggggaacaccgccatcatggccccggcccctcggggggtggagccgtcggaggcggcgatgctcaccagctccaccggacgcccctcctccagagcgtggacgatctctctgaaaaattcccgcatatcagccgattcctccgttcacagcgcccaggatcaggaccagtaccgtcacgccgcagtacagatattttgccgtcgggtaaaaccagcggcccagagggcgccgccgggccagattcacctgaaccaagcagtcctcctttttcagcacccagtagaagaacacccccgccagcagcgcgccgatgggacaggcgtagatggagcagacatccatccagccggagacgatgccctggatgcacagccccacggccaggcccacgacgccgatcaccgccacagcagtcccccggctgaggtgcagcttctcctgcagggtggcggtgggagcctcgaacaagttcaccagggacgtcaccccggcgaacaacgccgccacaaagaacaccgccatgaggatccggcctcccggcatctcccggaacaggttgggcaggtagatgaacatgaggccagggccgctctgggtcagggtctcccccgccgtggccatggccgggataatgaccagggcgctgaggatcgcggccatgctgtcaaagaacgccactgtccgggcagactccggcacgtccgcctctttggagaggtaggacccgtagatcagggtgccgttccctgccaccgacagagagaagaacgcctgtcccagagcgtagacccataccatggggtccagcagtccctccggcttcaggacaaagatgtagcggtagccgtccgccgcgccgggcaaggtggcaatgtagatggccagccccacgaacaggcagaagaacaggggcatcatcaccttgttggcccgctcgatgccgccgccgatgccaagggccatgatgagcagcgtgcccgccatagcggccacctgccagccggtgttgccccaggaggacgccgcggtgtcgaaataggcggtgaatgcctccaccccttggttctccagcgcagcgcccgtaaaggacgccacggcgtacttcaaaatccaaccaaccaccacggaatagccgatggccatggccagagagcccgccaccgggatgaggcccagagcctcgccccagccccgccggcctgtgcgcctctctgccgccgtgccgaaggccgccacgggtccgccggatgcggcccggccgaaggccatctcgccgatgacgccggtggaggcaatcagcaccacaaagatcacataggggatcaggaaggtggccccgccgtaggcggacatccgggatggaaacagccagatgttccccatccccaccgcggagccgatgcaggccagcttgaatccccagcgggaccggaagctgtcccgtcttgtctgttccatgattttttcctctcttctctcaaaactgcggcggcccgccgcggcgcgcgtcagccggcgccccgcttttgcagctcctcacccagcaggcgcactgcctggtccagatagaattggagcggctgggattcccccacggccagccggatgctgcatcgctgagagggcagcagaatcttcaccgcctcgctgccgccaatggcctccgccatccggggagagacctcccccagcaagccgttgggcgtcagcacaccgatgggccccagcaggatatccgcccgccgggcgttgaacgccacggcgttctcgccggtggcgccgtcatccgcccccgcccgcagcatagcggcggtggccagagagttggtccccagcgcccgcacatggagactgggccactttttcttcacagcctccaccaggccccggcccatgccgccgccctggccgtccaccacggccaccagcagttccccacgcatcattctctccattcctccattttcagatctccctttcagcatacccattccgcccccgcttgtcaacttcttccgcagcgtccatcgcgccttgcagagcgcctgcgcccacccttgtatttttcccgcatggcagctacaatgggaggcgcaccaccgtgtcaaaaaatttttggagatattgaagaaatccggcccgcagtcccgtatgatagatgtcggacgacaaaaggaggtggcggcacggcgtgaacaaactgacaaacgcgtccttttcccagctggtagtccagtatgagcggctggtctacacggtctgcttccagctggtgcgggacgccgccgcggccgaggacctgacccaggagaccttcctgtccgcctacctccaccgggacgccatccctcccggctatgagcggcagtggctgtgccgcgtggccaccaacaaggccaaggactacttacagagcgcctatcagcgccacaccctgctgccgggagaggacaatatcccgccggggctgtctccccctgcggaggagacggtcctgcgcaggtcggctgcagctgaaatccgggacctgatcctccatatgcgccagccctaccagccggtgtgccggctgtgcctgctggaggaaaagacaccggaggaggcggccctggcgctgggccggccggtaaagaccatccatacacagctgtcccggggcaagcggatgcttcgggaggcattggaaaggagtgggaacgatgacatgctttcgccctgacgggcatttgacggacgcggccctgaccgcccttgtccggggggactgcctggaggagctggaccgcctggagctggcggaacatctggcctactgcgaccagtgcctccagcggtacacagagctgctgtctgagggaccgatgctgacccccgcccgctcctgccgggagagcctgcggcgccggatccggcagcgggccgtccagcttggcgtcagccggtacgccacggccgcggcggcagtgaccctggccctgacgctgctgtggggcagcggaaacctgtccggacgggtgcattccactgcgccctcgcttctggagcgggcgggcactgccctgacaaagtggaccgacgcctggccacaggcgtgggaggaggccctctccggcttctccggcctatttgacaatttcggcgtctcgccgcggaatgatctgacacaaggaggtacacacccatgacccatcgaaatggattcctgctcttcatctcttcctgcctctccggctgcggacagatgtatcagggctatatgaagcggggcctgtccctgctgctggccttctgcctgatcctttttgcctccacctatttctttctgggggcactggcgctgtttctgccggtgatctggctgtatgcctttttcgacagctatgcgctccggagccagctggccgccggcaccgcgccggaggacgccttcctcttcggcctgtccgatatggacagcaaacggctgggagagctgctgcgcaagcgtcacagtctcatcggctgggcgctggtggtagttggcgtctatatgctctacgacatactgttgagccagctgggcggtctcttcttcggttggttcggggagtggctatacggactgctgcgctatggcctgccccgcctggtcatcaccgtgctagtgatcctgctgggcctgtggtttatccggggccccaaggacaagacgcccattgacgacgagatcccccctttgcgccgcctgcctccagcgcggccggggcttgcgccgccgatccggcggaggccagggcggaagacgttgcatcagaccgctccgctgcgggaaacgccccggagggagaggaggcccaccgtgatgaacagccctgagcagacgccggaatcccgtccggcccgggatcgccgggtgggcaccttcaccttcggcgccgtgctggtgatctgcggtgcgctgatgctggtgagcatgttcttcccctccctggatctgaccctggccctgcagctctcgcccctgatcttggtctgtctgggcgtggaggtgctgctggccagccgctccggcgggaaaatccgctacgactgggtgggcatggtgctttgcttcgtcctggtcaccgcagcgctggtgttcttcggcatcgcctggtgcctggtgtaccacccggaggccgtcatccactactgatacgggtctgcgaaggccccggtgcattgcaccggggccttaccctttcttcttggttttcccgggaaaatccggtataatggagaaaatacctgccgcagaaaggaagaatcctcatgtctgattcgtttgaaatgcgccccatcgcccgcatccgcagcgacttcggctccaagttcggcgtccctcgtcagagcggtctggtggacgcgttggaggccgccgtggtgttcgaggagccctaccgcaatcctgacgccctgcgggggctggagggattctcccacatctggctgatctgggcctttcaccagtcccagcggccggaatggtcccccacagtccggccgccccggctgggaggcaatcagcgggtgggagtctttgccagccgctcccccttccggcccaatcccatcggcctctcctccgtgcggctggaccacatcgcgtacacggacgccttgggcccggtgctccatgtccgtggcgcagacctggtagacggcacccccatcctggacatcaagccttacctcccttacggggactgccacccggaggccaccggcggctttgccagcgagccggcgcgtcccacgctggaggtggaaatcccacccgccctgctggaccaactgcctccggaccggcgggaggccctgcgggatgtgttggccttggatccccgtccccggtatcagcaggacccggaccgggtgtacggcttcctcttcgccgggcaggaggtgagattcaccgtggatggagaccgcctgcaggtcgtggacatcaaatgaacgcaaggcaccccgggatatttcccggggcgcccgtcttttccgggcactcagcgcatggccagcgtcacgtcgccggtcaccgccagctcgccgtggttgtagacctcggcggagcaggtggcaatggccttctccacccgctcggaagccatcttggcgtggatctcgatggtatctcccggcaggatcttcttcagaaaccgcacattattgatccccaagaacagggggatcttccccgcataccgctccgcggacagcagcaggatatccgccgtctgggccatgcattccacagagtacacgccgggcagcaccggctcaccggggaagtggcccttgaaaatctcgcgggccgggtccacaaaaaatgtggtcacgatgtggtcgcctgcctccatctcctccacggtatccaccagcagcatggggtcccggtgggggatgatggccttgatctcttctttggaaagcttcatgatagtggttcctctctttcgcgcaaaacgctccgtatataagccgcgccgggacagcggcacggctctgcctctttttattgtactgccgacagggcaaaatgcaagagataatttgcgctccggatcacaaaagagagccgccctcccgggcggctctctcattttccagatggggtgccttacttcgcagccttggcggccttgatggcctcgatcagcatgggggtgaccttgaacaggtcgccgcagatgccgtagtcggcaatctcgaagatgggcgcagtgtcgttcttgttcaccgcgatgatgcactcggagtcctgcataccggccttgtgctggatggcgccggagatgcccagggcgatgtacaccttcggatgcaccgtcttgccggtctggcccacctgatggtcggcagacagccagccggagtcgatggtggcacgggagccgcccacgacgccgcccaggacgtccgccagctcctcagccagcttgataccgccctcgacatccttgctgatgccgcggcccacagacacgatgtagtccgcgccgatcaggtccaccagcttcttggcggccttcacgacctccacaacctcggtgttcaggtcgctctcgctcagctggaagctgggcttcacgatctcgcacgcatccgccttggcctggtcgaagacgttcttcttcatcacgccggggcgcaccgtcgccatgcagggacggaaccgcgggcagatgatggtggccatcaggtggccgccgaaggccggacgggtcatcttcaggttccggtcctccatatcccacttctggctgtccacgtccagggtgctggactcacgcaggaactggatgtagttcgccacatccacgtccaggtgggtgcagtcggcgcacaggccggtatgcagacgggccgcgcagcggggccccaggtcacggccgatgttggtggcgccgatcaggaacgcctcgggcttcagatcctcgatcacgtcgcagatgaccttggcataggcatcggtgttgtagacggccagcagggggctctcgcacaccagcaccttgtcggcgccgtagccgcccagctccttggcagcggactcgatgccctcgccgcccagcagcaggccgcacaggttcacgcccagctcgtcggccaggtcgcggcccttggagatcagctcaaagtcggtgggcatcagtttgccctcgcgctgctcgcagaagacccacacatccttgaaagcagcgatatcagcgctattgaaattggacattgttcaaatactcccttctcagatgatgtgcttggcggccagaatggaagccagctcctcgcaggtctctttgccggcaccctccagcatcttgccggcgcccttctggggcggggtgaagctcttgaagatgttggtgggagagcccttcaggccgatggtggtggcgtcgatcaggggatgatccttcagcttctcatagtcaaaggtctccagcggcttgttgtaggtggcatagatgccgtcgatgctcatatagcggggctcgttcagctccttgatgcaggtaagcaggcagggagtcttgaccttgatggtcatgtagccgtcctccagcatccgcttgacggtgatggtgttgccgtccttggtgatgtcggcggcgtaggtcacctggggcaggtgcagcttctcagcgatctgggggcccacctgggcggtgtcgccgtcgatggcctgccggccgcacatgacgatgtcgtcctcctccacaccgatggtggagatggcggcggccaggatctgggaggtggcgtatgtatcggagccgccgaactcgcgggcggataccaggacaccctcgtcagcgcccatggccatcagctcccgcagcatgccggctgccgggggcggacccatggtgacgaccatgaccttgcagccggtggcatccttcagcttcagggcagcctccacggcgttcatgtcatcggggttggtgatggtctgcatggaggcacggttcagggtgccatccgggttcaccgccaccttgccggaggtatcggggacctgcttgacgcaaacaatgatcttcataattcgttcttcctcctcttacaggccgatattgccggagatgaccacacgctggatttcgctggtgccctcatagatctcggtgatcttggcgtcgcgcatcatgcgctccaggggatagtccttggtgtagccgtagccgccgaacatctgcagcgccttggtggtggtcagcatggcgtgctcagagcagaacagcttggccatggccgcctccttggtgaagcgcttgccctcgcccttcagcacggcggcctgataggtcagcaggcggcccgcctcggagcgcatcgccatgtcggcgaaggtgaactgggtgttctggaacttgctgatgggcttgccgaactggacacggcccttggtgtaggccatggcctcttccatggcgccctcggcaatgcccagagcctgggccgcgatgccgatgcggccgccgtccagggtctgcatggcgatcttgaagcccttgccctcctggcccagcaggttctccttgggaacgatgcagtcggtgaacacgatctcggcggtgggggagccgtgcaggcccatcttctcttcgtgcttgcccacggagaagccggggaagctgctctccacgatgaaggcggagatgccgcgggtgcccttggacttgtcggtcatggcgaagaccacgaacacgtcggccacgtagccgttggtgatgaagatcttggagccgttgaggacatagtggtcgccgtccagcttggcctc

(The sequence listing continues in the following parts.)

The invention claimed is:

1. A method for treating metabolic syndrome in a subject in need thereof, comprising administering to said subject a therapeutically effective amount of at least one isolated bacterium belonging to the genus *Dysosmobacter*, wherein the nucleotide sequence of the 16S rRNA gene of said isolated bacterium has at least 98% identity with SEQ ID NO: 1.

* * * * *